US009493843B2

(12) United States Patent
Chaky et al.

(10) Patent No.: US 9,493,843 B2
(45) Date of Patent: Nov. 15, 2016

(54) **GENETIC LOCI ASSOCIATED WITH *PHYTOPHTHORA* TOLERANCE IN SOYBEAN AND METHODS OF USE**

(71) Applicant: Pioneer Hi-Bred International, Inc., Johnston, IA (US)

(72) Inventors: Julian M. Chaky, Urbandale, IA (US); Holly J. Jessen, Chanhassen, MN (US); Joshua M. Shendelman, Ankeny, IA (US); Paul A. Stephens, Urbandale, IA (US); David M. Webb, Zionsville, IN (US); John B. Woodward, Ankeny, IA (US); Meizhu Yang, Johnston, IA (US)

(73) Assignee: PIONEER HI-BRED INTERNATIONAL, INC., Johnston, IA (US)

( * ) Notice: Subject to any disclaimer, the term of this patent is extended or adjusted under 35 U.S.C. 154(b) by 594 days.

(21) Appl. No.: 13/782,013

(22) Filed: Mar. 1, 2013

(65) Prior Publication Data

US 2014/0178867 A1 Jun. 26, 2014

Related U.S. Application Data

(60) Provisional application No. 61/740,262, filed on Dec. 20, 2012.

(51) Int. Cl.
| | |
|---|---|
| *C12Q 1/68* | (2006.01) |
| *A01H 1/04* | (2006.01) |
| *A01H 4/00* | (2006.01) |
| *A01H 5/10* | (2006.01) |
| *A01H 1/02* | (2006.01) |

(52) U.S. Cl.
CPC ............. *C12Q 1/6895* (2013.01); *A01H 1/02* (2013.01); *A01H 1/04* (2013.01); *A01H 4/00* (2013.01); *A01H 5/10* (2013.01); *C12Q 2600/13* (2013.01); *C12Q 2600/156* (2013.01); *C12Q 2600/172* (2013.01)

(58) Field of Classification Search
CPC .................................................. C12Q 1/6895
See application file for complete search history.

(56) References Cited

U.S. PATENT DOCUMENTS

| | | | |
|---|---|---|---|
| 5,574,210 A | 11/1996 | Saghai-Maroof et al. | |
| 6,162,967 A | 12/2000 | Webb | |
| 6,953,877 B2 | 10/2005 | Hedges | |
| 7,381,862 B2 | 6/2008 | St. Martin et al. | |
| 7,435,873 B2 | 10/2008 | St. Martin et al. | |
| 2006/0059580 A1* | 3/2006 | Han et al. | 800/267 |
| 2008/0127361 A1 | 5/2008 | St. Martin et al. | |
| 2008/0263720 A1* | 10/2008 | Behm et al. | 800/265 |

FOREIGN PATENT DOCUMENTS

| | | |
|---|---|---|
| WO | WO 98/49887 | 11/1998 |
| WO | WO 99/31964 A | 7/1999 |
| WO | WO 03/094601 | 11/2003 |
| WO | PCT/US13/76206 | 12/2013 |

OTHER PUBLICATIONS

Sugimoto et al., 2012. Pathogenic diveristy of Phytophthora sojae and breeding strategies to develop Phytophthora-resistant soybeans. Breeding Science 61: 511-522.*
Batley, Jacqueline, and David Edwards. "SNP applications in plants." Association mapping in plants. Springer New York, 2007. 95-102.*
Quinn, E. A., et al. "Development of sequence characterized amplified region (SCAR) primers for the detection of Phyto. 5.2, a major QTL for resistance to Phytophthora capsici Leon. in pepper." Theoretical and Applied Genetics 110.4 (2005): 605-612.*
Varala, et al. 2011. Rapid genotyping of soybean cultivars using high throughput sequencing. e24811.*
Weng, C., et al. 2001. Mapping genes conferring resistance to *Phytophthora* root rot of soybean, Rps1a and Rps7. Journal of Heredity 92.5: 442-446.*
Thomas, J.P. 1985. Detection and identification: how are they related . . . J. Opt. Soc. Am. 2: 1457-1467.*
Bui, A.Q., et al. (2008) "A Transcriptome of Soybean Seeds Containing Globular-Stage Embryos," pp. 1-2. GenBank Accession No. GD922871, http://www.ncbi.nlm.nih.gov/nucest/GD922871 (Accessed on Aug. 18, 2014).
Burnham, K.D., et al. (2003) "Quantitative Trait Loci for Partial Resistance to *Phytophthora sojae* in Soybean," *Crop Sci.*, 43: 1610-1617.
Chang, S.J.C., et al. (1996) "Two Additional Loci Underlying Durable Field Resistance to Soybean Sudden Death Syndrome (SDS)," *Crop Sci.* 36: 1684-1688.
Coryell, V.H., et al. (1999) "Allele specific hybridization markers for soybean," *Theor. Appl. Genet.* 98: 690-696.
Cregan, P.B., et al. (1999) "An Integrated Genetic Linkage Map of the Soybean Genome," *Crop Sci.* 39: 1464-1490.
Demirbas, A., et al. (2001) "Simple Sequence Repeat Markers Linked to the Soybean Rps Genes for Phytophtohora Resistance," *Crop Sci.* 41: 1220-1227.
Diwan, N. and Cregan, P. B. (1997) "Automated sizing of fluorescent-labeled simple sequence repeat (SSR) markers to assay genetic variation in Soybean," *Theor. Appl. Genet.* 95: 723-733.
Dou, D., et al. (2010) "Different Domains of *Phytophthora sojae* Effector Avr4/6 Are Recognized by Soybean Resistance Genes Rps4 and Rps6," *Molecular Plant-Microbe Interactions* 23(4): 425-435.

(Continued)

*Primary Examiner* — David T Fox
*Assistant Examiner* — Karen Redden

(57) ABSTRACT

Various methods and compositions are provided for identifying and/or selecting soybean plants or soybean germplasm with tolerance or improved tolerance to *Phytophthora* infection. In certain embodiments, the method comprises detecting at least one marker locus that is associated with tolerance to *Phytophthora* infection. In other embodiments, the method further comprises detecting at least one marker profile or haplotype associated with tolerance to *Phytophthora* infection. In further embodiments, the method comprises crossing a selected soybean plant with a second soybean plant. Further provided are markers, primers, probes and kits useful for identifying and/or selecting soybean plants or soybean germplasm with tolerance or improved tolerance to *Phytophthora* infection.

13 Claims, 15 Drawing Sheets

(56) References Cited

OTHER PUBLICATIONS

Glover, K.D. and Scott, R.A. (1998) "Heritability and Phenotypic Variation of Tolerance to *Phytophthora* Root Rot of Soybean," *Crop Sci.* 38: 1495-1500.

Haun, W. J., et al. (2011) "The Composition and Origins of Genomic Variation among Individuals of the Soybean Reference Cultivar Williams 82," *Plant Physiology* 155: 645-655.

Haussmann, B.I.G., et al. (2004) "Plant Genetic Resources in Crop Improvement" *Plant Genetic Resources* 2(1): 3-21.

Keim, P., et al. (1988) "Construction of a Random Recombinant DNA Library that is Primarily Single Copy Sequences," *Soybean Genet. Newsletter* 15: 147-148 (4 pages total).

Kim, C.G., et al. (2000) "Isolation and Differential Expression of an Acidic PR-1 cDNA Gene from Soybean Hypocotyls Infected with *Phytophthora sojae* f. sp. glycines" *Plant Pathol. J.* 16(1): 9-18.

Lander, E. S., and Botstein, D. (1989) "Mapping Mendelian factors underlying quantitative traits using RFLP linkage maps," *Genetics* 121(1): 185-199.

Liao, Y., et al. (2008) "Soybean GmbZIP44, GmbZIP62 and GmbZIP78 genes function as negative regulator of ABA signaling and confer salt and freezing tolerance in transgenic Arabidopsis," *Planta* 228: 225-240.

McBlain, B.A., et al. (1991) "Tolerance of *Phytophthora rot* in Soybean: II. Evaluation of Three Tolerance Screening Methods," *Crop Sci.* 31: 1412-1417.

Qutob, D., et al. (2000) "Comparative Analysis of Expressed Sequences in Phytophthora sojae," *Plant Phys.* 123: 243-253.

Stuber, C.W., et al. (1999) "Synergy of Empirical Breeding, Marker-Assisted Selected, and Genomics to Increase Crop Yield Potential," *Crop Sci.* 39: 1571-1583.

Wang, H., et al. (2012) "Dissection of two soybean QTL conferring partial resistance to Phytophthora sojae through sequence and gene expression analysis," *BMC Genomics* 13: 428-451.

Wu, C., et al. (2004) "A BAC and BIBAC-based Physical Map of the Soybean Genome," *Genome Res.* 14: 319-326.

Young, N. D. (1996) "QTL Mapping and Quantitative Disease Resistance in Plants," *Annu. Rev. Phytopathol.* 34: 479-501.

Yuan, J. et al. (2002) "Quantitative trait loci in two soybean recombinant inbred line populations segregating for yield and disease resistance," *Crop Sci.* 42: 271-277.

International Search Report and Written Opinion mailed Jun. 26, 2014 for PCT/US2013/076206 filed Dec. 18, 2013. (Applicant—Pioneer Hi-Bred International, Inc. // Inventors—Chaky et al.) (14 pages).

U.S. Appl. No. 61/740,262, filed Dec. 20, 2012, Julian M. Chaky (Pioneer Hi-Bred International, Inc.).

* cited by examiner

Figure 1A

| Locus Name | LG | Physical | Genetic Consensus4.0 Positions |
|---|---|---|---|
| BARC-062759-18042 | N_(3) | 113,785 | 4.08 |
| BARCSOYSSR_03_0017 | N_(3) | 324,517 | 4.79 |
| Sct_195 | N_(3) | 324,517 | 4.79 |
| BARC-052169-11380 | N_(3) | 1,118,143 | 12.53 |
| BARC-052165-11373 | N_(3) | 1,163,561 | 12.53 |
| BARC-052161-11372 | N_(3) | 1,163,582 | 12.53 |
| BARC-029963-06759 | N_(3) | 1,530,285 | 13.40 |
| BARC-055693-13602 | N_(3) | 1,645,192 | 13.95 |
| BARC-051299-11076 | N_(3) | 1,787,169 | 14.40 |
| BARC-042969-08479 | N_(3) | 1,999,721 | 15.73 |
| BARC-044123-08622 | N_(3) | 2,277,699 | 16.78 |
| BARC-030965-06980 | N_(3) | 2,785,615 | 19.38 |
| BARCSOYSSR_03_0162 | N_(3) | 2,916,474 | 20.51 |
| Satt631 | N_(3) | 2,916,474 | 20.51 |
| BARC-028645-05979 | N_(3) | 2,993,643 | 21.13 |
| BARCSOYSSR_03_0180 | N_(3) | 3,170,142 | 21.29 |
| Satt159 | N_(3) | 3,170,142 | 21.29 |
| BARC-031833-07221 | N_(3) | 3,299,128 | 21.83 |
| S16592-001 | N_(3) | 3,904,033 | 22.58 |
| S08291-1 | N_(3) | 3,905,604 | 22.58 |
| BARCSOYSSR_03_0226 | N_(3) | 3,910,284 | 22.59 |
| Satt009 | N_(3) | 3,910,284 | 22.59 |
| S07963-2 | N_(3) | 3,951,705 | 22.63 |
| S08013-1 | N_(3) | 4,458,273 | 23.17 |
| S07292-1 | N_(3) | 4,464,524 | 23.17 |
| BARCSOYSSR_03_0257 | N_(3) | 4,554,677 | 23.27 |
| Satt641 | N_(3) | 4,554,677 | 23.27 |
| BARC-064081-18547 | N_(3) | 4,993,899 | 23.85 |
| S07372-1 | N_(3) | 5,227,883 | 24.46 |
| BARC-016199-02307 | N_(3) | 5,808,783 | 25.97 |
| BARC-024681-05527 | N_(3) | 6,922,908 | 26.81 |
| BARC-051729-11232 | N_(3) | 8,704,943 | 27.18 |
| BARCSOYSSR_03_0483 | N_(3) | 13,899,275 | 28.39 |
| Satt485 | N_(3) | 13,899,275 | 28.39 |
| BARC-057823-14942 | N_(3) | 14,987,500 | 28.46 |
| BARC-061115-17056 | N_(3) | 18,958,974 | 29.59 |
| BARC-050955-10882 | N_(3) | 19,182,593 | 29.60 |
| BARC-060803-16908 | N_(3) | 24,935,361 | 30.52 |
| BARC-047929-10431 | N_(3) | 27,977,273 | 30.59 |
| BARC-047931-10433 | N_(3) | 27,979,865 | 30.59 |

Figure 1B

|  | N_(3) | 28,330,059 | 30.72 |
|---|---|---|---|
| BARC-060707-16809 | N_(3) | 29,090,285 | 30.86 |
| BARC-052725-11576 | N_(3) | 30,470,826 | 31.10 |
| BARC-016467-02618 | N_(3) | 33,396,107 | 32.62 |
| BARCSOYSSR_03_0983 | N_(3) | 34,710,442 | 35.19 |
| Sat_280 | N_(3) | 34,710,442 | 35.19 |
| BARC-065459-19489 | N_(3) | 35,169,567 | 37.47 |
| BARC-013561-01160 | N_(3) | 35,318,305 | 37.89 |
| BARC-013599-01171 | N_(3) | 35,583,354 | 38.00 |
| BARCSOYSSR_03_1075 | N_(3) | 36,046,736 | 39.72 |
| Sat_266 | N_(3) | 36,046,736 | 39.72 |
| BARC-035433-07199 | N_(3) | 36,785,458 | 42.40 |
| BARC-039287-07269 | N_(3) | 36,785,533 | 42.40 |
| BARC-050433-09624 | N_(3) | 37,047,429 | 44.99 |
| BARC-019375-03900 | N_(3) | 37,309,808 | 45.59 |
| BARCSOYSSR_03_1165 | N_(3) | 37,622,075 | 47.24 |
| Sat_236 | N_(3) | 37,622,075 | 47.24 |
| BARC-021465-04122 | N_(3) | 37,828,068 | 47.79 |
| BARC-002118-00086 | N_(3) | 38,031,755 | 48.25 |
| BARC-010179-00543 | N_(3) | 38,032,014 | 49.69 |
| BARC-018929-03038 | N_(3) | 38,076,895 | 50.43 |
| BARC-040277-07705 | N_(3) | 38,389,688 | 53.13 |
| BARCSOYSSR_03_1258 | N_(3) | 39,360,431 | 57.27 |
| Satt549 | N_(3) | 39,360,431 | 57.27 |
| BARCSOYSSR_03_1275 | N_(3) | 39,627,567 | 58.57 |
| Satt660 | N_(3) | 39,627,567 | 58.57 |
| BARC-038823-07342 | N_(3) | 39,692,625 | 58.66 |
| BARC-014927-01923 | N_(3) | 39,795,065 | 59.27 |
| BARCSOYSSR_03_1302 | N_(3) | 39,840,201 | 59.54 |
| GMABAB | N_(3) | 39,840,201 | 59.54 |
| BARC-010211-00550 | N_(3) | 39,840,815 | 59.65 |
| BARC-048763-10711 | N_(3) | 39,842,964 | 59.91 |
| BARCSOYSSR_03_1307 | N_(3) | 39,934,569 | 60.17 |
| Satt339 | N_(3) | 39,934,569 | 60.17 |
| BARC-024777-05683 | N_(3) | 40,018,491 | 60.48 |
| BARC-023367-05353 | N_(3) | 40,088,284 | 60.66 |
| BARC-023365-05350 | N_(3) | 40,115,382 | 60.67 |
| BARC-046426-12582 | N_(3) | 40,307,332 | 60.96 |
| BARC-028205-05791 | N_(3) | 40,462,431 | 61.33 |
| BARC-016485-02069 | N_(3) | 40,585,252 | 61.48 |
| BARC-029415-06172 | N_(3) | 40,805,854 | 61.80 |

Figure 1C

| | | | |
|---|---|---|---|
| BARC-020101-04452 | N_(3) | 41,146,718 | 62.62 |
| BARC-046692-12696 | N_(3) | 41,231,762 | 63.13 |
| BARC-046758-12733 | N_(3) | 41,234,262 | 63.13 |
| BARCSOYSSR_03_1387 | N_(3) | 41,732,537 | 65.90 |
| Satt312 | N_(3) | 41,732,537 | 65.90 |
| BARC-013865-01261 | N_(3) | 41,779,870 | 66.30 |
| BARC-047693-10381 | N_(3) | 42,027,991 | 67.51 |
| BARCSOYSSR_03_1412 | N_(3) | 42,180,031 | 69.28 |
| Satt234 | N_(3) | 42,180,031 | 69.28 |
| BARCSOYSSR_03_1454 | N_(3) | 42,834,621 | 71.71 |
| Sat_239 | N_(3) | 42,834,621 | 71.71 |
| BARCSOYSSR_03_1469 | N_(3) | 43,078,322 | 73.01 |
| Sat_241 | N_(3) | 43,078,322 | 73.01 |
| BARC-028745-06004 | N_(3) | 43,242,194 | 73.63 |
| BARC-028539-05944 | N_(3) | 43,488,305 | 74.16 |
| BARC-021293-04029 | N_(3) | 43,504,295 | 74.29 |
| BARCSOYSSR_03_1492 | N_(3) | 43,533,807 | 74.71 |
| Satt257 | N_(3) | 43,533,807 | 74.71 |
| BARCSOYSSR_03_1493 | N_(3) | 43,594,194 | 76.65 |
| Sat_306 | N_(3) | 43,594,194 | 76.65 |
| BARC-048557-10665 | N_(3) | 43,809,381 | 79.05 |
| BARC-061771-17371 | N_(3) | 44,172,012 | 80.70 |
| BARCSOYSSR_03_1540 | N_(3) | 44,682,640 | 84.45 |
| Satt022 | N_(3) | 44,682,640 | 84.45 |
| BARC-065687-19660 | N_(3) | 44,732,101 | 85.08 |
| BARCSOYSSR_03_1546 | N_(3) | 44,771,047 | 85.40 |
| Sat_125 | N_(3) | 44,771,047 | 85.40 |
| BARC-027930-06703 | N_(3) | 44,947,921 | 85.82 |
| BARC-044603-08734 | N_(3) | 45,007,813 | 85.82 |
| BARC-031999-07236 | N_(3) | 45,098,078 | 86.21 |
| BARC-060109-16388 | N_(3) | 45,391,016 | 86.91 |
| BARC-016535-02085 | N_(3) | 45,416,293 | 88.23 |
| BARC-018125-02530 | N_(3) | 45,517,348 | 88.78 |
| BARC-014575-01582 | N_(3) | 45,597,671 | 91.19 |
| BARC-060031-16308 | N_(3) | 46,177,225 | 92.06 |
| BARC-029409-06170 | N_(3) | 46,403,735 | 92.72 |
| BARC-054507-12102 | N_(3) | 46,416,790 | 92.72 |
| BARC-045143-08893 | N_(3) | 47,154,494 | 94.69 |
| BARC-030669-06920 | N_(3) | 47,161,222 | 94.69 |
| BARC-900569-00953 | N_(3) | 47,181,930 | 94.69 |
| BARC-039729-07559 | N_(3) | 47,463,739 | 96.07 |

Figure 2A

| Locus Name | LG | Physical | Genetic Consensus4.0 Positions |
|---|---|---|---|
| BARC-017209-02250 | F_(13) | 730,833 | 5.44 |
| BARCSOYSSR_13_0062 | F_(13) | 1,294,413 | 9.67 |
| Satt659 | F_(13) | 1,294,413 | 9.67 |
| BARC-025291-06469 | F_(13) | 1,456,775 | 10.02 |
| BARCSOYSSR_13_0099 | F_(13) | 1,909,350 | 11.55 |
| Sat_039 | F_(13) | 1,909,350 | 11.55 |
| BARC-027474-06587 | F_(13) | 2,028,114 | 11.77 |
| BARC-032373-08957 | F_(13) | 2,708,409 | 13.08 |
| BARC-065403-19439 | F_(13) | 2,776,800 | 13.08 |
| BARC-051955-11307 | F_(13) | 3,140,575 | 15.04 |
| BARC-064051-18538 | F_(13) | 4,198,168 | 18.38 |
| BARC-016463-02617 | F_(13) | 4,208,231 | 18.42 |
| BARC-051237-11031 | F_(13) | 4,227,643 | 18.55 |
| BARC-051235-11030 | F_(13) | 4,246,363 | 18.61 |
| BARC-066191-19815 | F_(13) | 4,553,351 | 19.16 |
| BARC-035375-07174 | F_(13) | 4,556,823 | 19.18 |
| BARC-059869-16174 | F_(13) | 4,583,951 | 20.08 |
| BARC-043267-08567 | F_(13) | 5,043,469 | 20.99 |
| BARCSOYSSR_13_0272 | F_(13) | 5,376,598 | 22.62 |
| Satt252 | F_(13) | 5,376,598 | 22.62 |
| BARCSOYSSR_13_0282 | F_(13) | 5,491,280 | 23.35 |
| Satt348 | F_(13) | 5,491,280 | 23.35 |
| BARC-013115-01441 | F_(13) | 6,069,736 | 24.26 |
| BARCSOYSSR_13_0340 | F_(13) | 6,580,549 | 27.45 |
| Satt269 | F_(13) | 6,580,549 | 27.45 |
| BARCSOYSSR_13_0341 | F_(13) | 6,593,658 | 27.61 |
| Satt145 | F_(13) | 6,593,658 | 27.61 |
| BARC-042289-08234 | F_(13) | 6,780,758 | 27.94 |
| BARC-049723-09133 | F_(13) | 7,103,710 | 29.63 |
| BARC-051405-11095 | F_(13) | 7,521,465 | 31.01 |
| BARC-058031-15072 | F_(13) | 7,700,339 | 31.36 |
| BARC-059611-15942 | F_(13) | 7,755,550 | 31.55 |
| BARC-046112-10273 | F_(13) | 7,858,072 | 32.14 |
| BARC-043173-08548 | F_(13) | 8,264,459 | 33.67 |
| BARC-016943-02391 | F_(13) | 8,529,450 | 33.93 |
| BARC-018551-02971 | F_(13) | 8,529,473 | 34.07 |
| BARCSOYSSR_13_0445 | F_(13) | 8,722,718 | 34.39 |
| Satt030 | F_(13) | 8,722,718 | 34.39 |

Figure 2B

| | | | |
|---|---|---|---|
| BARCSOYSSR_13_0458 | F_(13) | 9,567,240 | 34.72 |
| Satt569 | F_(13) | 9,567,240 | 34.72 |
| BARC-064377-18635 | F_(13) | 10,551,898 | 34.86 |
| BARC-024749-05639 | F_(13) | 10,719,759 | 35.01 |
| BARC-023287-05318 | F_(13) | 10,722,785 | 35.01 |
| BARCSOYSSR_13_0518 | F_(13) | 11,494,492 | 35.29 |
| Satt343 | F_(13) | 11,494,492 | 35.29 |
| BARC-019391-03903 | F_(13) | 11,513,020 | 35.44 |
| BARC-014099-01531 | F_(13) | 11,513,023 | 35.44 |
| BARC-049859-09180 | F_(13) | 12,279,425 | 35.98 |
| BARC-024639-05505 | F_(13) | 12,952,996 | 36.54 |
| BARC-064897-18988 | F_(13) | 13,803,730 | 36.66 |
| BARC-061105-17048 | F_(13) | 13,826,582 | 36.67 |
| BARC-064849-18822 | F_(13) | 17,609,468 | 36.68 |
| BARC-062009-17616 | F_(13) | 19,330,460 | 36.74 |
| BARC-044797-08809 | F_(13) | 23,987,460 | 37.47 |
| BARCSOYSSR_13_0877 | F_(13) | 24,451,400 | 39.62 |
| Satt663 | F_(13) | 24,451,400 | 39.62 |
| BARCSOYSSR_13_0952 | F_(13) | 25,789,165 | 43.04 |
| Sat_297 | F_(13) | 25,789,165 | 43.04 |
| BARC-050657-09804 | F_(13) | 26,009,844 | 45.03 |
| BARC-025897-05144 | F_(13) | 27,144,939 | 49.42 |
| BARC-008001-00154 | F_(13) | 27,569,047 | 50.40 |
| BARC-038413-10074 | F_(13) | 27,781,754 | 50.71 |
| BARCSOYSSR_13_1098 | F_(13) | 28,415,998 | 51.20 |
| Satt334 | F_(13) | 28,415,998 | 51.20 |
| S07163-1 | F_(13) | 29,049,184 | 51.79 |
| S09018-1 | F_(13) | 29,110,641 | 51.85 |
| BARC-007567-00030 | F_(13) | 29,549,705 | 52.26 |
| BARC-041671-08065 | F_(13) | 30,268,846 | 53.20 |
| BARC-063863-18477 | F_(13) | 30,396,785 | 53.20 |
| BARC-030853-06954 | F_(13) | 30,581,858 | 54.08 |
| BARC-047961-10449 | F_(13) | 30,582,406 | 54.08 |
| BARC-013633-01184 | F_(13) | 30,771,429 | 55.32 |
| BARC-043227-08562 | F_(13) | 30,863,656 | 55.99 |
| BARC-015903-02010 | F_(13) | 30,965,576 | 56.03 |
| BARCSOYSSR_13_1241 | F_(13) | 30,984,460 | 56.89 |
| Sat_317 | F_(13) | 30,984,460 | 56.89 |
| BARC-018079-02510 | F_(13) | 31,994,036 | 60.49 |
| BARC-061189-17109 | F_(13) | 32,064,753 | 64.12 |
| BARC-039631-07532 | F_(13) | 32,179,461 | 65.09 |

Figure 2C

| | | | |
|---|---|---|---|
| BARC-013257-00462 | F_(13) | 32,207,393 | 65.13 |
| BARC-038503-10136 | F_(13) | 32,623,088 | 66.91 |
| BARC-041649-08056 | F_(13) | 33,280,536 | 68.55 |
| BARC-024045-04714 | F_(13) | 33,302,688 | 68.70 |
| BARC-039765-07568 | F_(13) | 33,302,789 | 68.73 |
| BARCSOYSSR_13_1369 | F_(13) | 33,555,511 | 69.12 |
| Sct_188 | F_(13) | 33,555,511 | 69.12 |
| BARC-047893-10417 | F_(13) | 33,591,576 | 69.33 |
| BARCSOYSSR_13_1385 | F_(13) | 33,860,249 | 69.98 |
| Sat_375 | F_(13) | 33,860,249 | 69.98 |
| BARC-018605-02982 | F_(13) | 33,962,287 | 70.04 |
| BARC-027502-06598 | F_(13) | 34,222,888 | 71.11 |
| BARC-032717-09021 | F_(13) | 34,437,496 | 71.22 |
| BARC-044875-08829 | F_(13) | 34,624,490 | 71.26 |
| BARC-055229-13122 | F_(13) | 34,739,895 | 71.89 |
| BARC-031567-07110 | F_(13) | 34,841,259 | 71.89 |
| BARC-045235-08913 | F_(13) | 34,855,765 | 71.89 |
| BARC-018007-02494 | F_(13) | 35,393,757 | 74.03 |
| BARC-063121-18247 | F_(13) | 35,533,783 | 74.33 |
| BARC-027622-06625 | F_(13) | 35,617,394 | 74.54 |
| BARC-025859-05126 | F_(13) | 35,862,469 | 75.44 |
| BARC-018177-02535 | F_(13) | 36,054,552 | 75.95 |
| BARC-055613-13490 | F_(13) | 36,204,226 | 77.16 |
| BARCSOYSSR_13_1522 | F_(13) | 36,401,759 | 77.32 |
| Sat_197 | F_(13) | 36,401,759 | 77.32 |
| BARC-025561-06521 | F_(13) | 36,822,800 | 78.34 |
| BARC-014657-01608 | F_(13) | 37,024,135 | 79.43 |
| BARC-039175-07463 | F_(13) | 37,452,579 | 80.29 |
| BARC-027792-06674 | F_(13) | 38,023,035 | 85.18 |
| BARC-046144-10286 | F_(13) | 38,030,995 | 85.18 |
| BARCSOYSSR_13_1617 | F_(13) | 38,075,339 | 87.79 |
| Satt554 | F_(13) | 38,075,339 | 87.79 |
| BARCSOYSSR_13_1646 | F_(13) | 38,558,080 | 91.39 |
| Satt657 | F_(13) | 38,558,080 | 91.39 |
| BARC-061571-17276 | F_(13) | 38,566,348 | 91.63 |
| BARC-063309-18328 | F_(13) | 38,566,921 | 91.63 |
| BARCSOYSSR_13_1672 | F_(13) | 38,955,502 | 93.73 |
| Satt522 | F_(13) | 38,955,502 | 93.73 |
| BARC-026113-05263 | F_(13) | 39,216,776 | 95.85 |
| BARC-038355-10050 | F_(13) | 39,539,890 | 96.91 |
| BARCSOYSSR_13_1747 | F_(13) | 40,160,823 | 98.17 |

Figure 2D

| | | | |
|---|---|---|---|
| AW756935 | F_(13) | 40,160,823 | 98.17 |
| BARC-013325-00483 | F_(13) | 40,685,775 | 99.37 |
| BARC-013325-00484 | F_(13) | 40,685,775 | 100.61 |
| BARC-042953-08476 | F_(13) | 41,219,915 | 102.16 |
| BARCSOYSSR_13_1803 | F_(13) | 41,259,685 | 102.95 |
| Sat_090 | F_(13) | 41,259,685 | 102.95 |
| BARCSOYSSR_13_1837 | F_(13) | 41,868,210 | 104.84 |
| Sat_417 | F_(13) | 41,868,210 | 104.84 |
| BARCSOYSSR_13_1838 | F_(13) | 41,885,014 | 106.55 |
| Satt656 | F_(13) | 41,885,014 | 106.55 |
| BARC-018741-02997 | F_(13) | 41,885,841 | 107.33 |
| BARC-014363-01336 | F_(13) | 42,334,157 | 108.26 |
| BARC-017179-02236 | F_(13) | 42,483,466 | 108.82 |
| BARC-064221-18586 | F_(13) | 42,797,894 | 111.07 |
| BARC-050361-09572 | F_(13) | 42,797,918 | 111.08 |
| BARC-014299-01307 | F_(13) | 42,920,500 | 112.25 |
| BARC-021845-04222 | F_(13) | 43,826,000 | 116.89 |
| BARC-028899-06036 | F_(13) | 44,238,149 | 118.26 |

Figure 3A

| Locus Name | LG | Physical | Genetic Consensus4.0 Positions |
|---|---|---|---|
| BARC-016027-02038 | J_(16) | 133,348 | 2.34 |
| BARC-028423-05867 | J_(16) | 724,502 | 4.91 |
| BARC-013639-01204 | J_(16) | 774,054 | 5.42 |
| BARC-063377-18348 | J_(16) | 1,061,926 | 8.18 |
| BARC-024473-04898 | J_(16) | 1,103,589 | 8.58 |
| BARCSOYSSR_16_0062 | J_(16) | 1,141,072 | 10.55 |
| Satt249 | J_(16) | 1,141,072 | 10.55 |
| BARC-013651-01218 | J_(16) | 1,348,520 | 11.40 |
| BARCSOYSSR_16_0083 | J_(16) | 1,543,289 | 12.13 |
| Satt674 | J_(16) | 1,543,289 | 12.13 |
| BARCSOYSSR_16_0090 | J_(16) | 1,631,806 | 12.21 |
| Satt287 | J_(16) | 1,631,806 | 12.21 |
| BARC-018981-03289 | J_(16) | 2,314,419 | 19.26 |
| BARCSOYSSR_16_0171 | J_(16) | 2,893,992 | 22.52 |
| Sct_046 | J_(16) | 2,893,992 | 22.52 |
| BARCSOYSSR_16_0179 | J_(16) | 3,050,011 | 22.97 |
| Sat_228 | J_(16) | 3,050,011 | 22.97 |
| BARC-028599-05966 | J_(16) | 3,137,659 | 23.17 |
| BARC-059355-15761 | J_(16) | 3,363,314 | 24.28 |
| BARC-042521-08287 | J_(16) | 3,534,838 | 24.37 |
| BARC-013299-00471 | J_(16) | 3,597,317 | 24.82 |
| BARC-014573-01581 | J_(16) | 3,597,402 | 24.82 |
| BARC-018093-02513 | J_(16) | 3,847,598 | 25.29 |
| BARC-045157-08897 | J_(16) | 3,900,245 | 25.35 |
| BARC-014467-01559 | J_(16) | 3,962,333 | 25.69 |
| BARC-029477-06200 | J_(16) | 4,763,389 | 31.14 |
| BARC-031525-07106 | J_(16) | 4,924,406 | 34.78 |
| BARC-031195-07010 | J_(16) | 4,924,462 | 34.78 |
| BARC-028307-05823 | J_(16) | 4,936,902 | 34.78 |
| BARC-031951-07227 | J_(16) | 4,936,964 | 34.94 |
| BARC-065799-19753 | J_(16) | 5,040,869 | 35.44 |
| BARCSOYSSR_16_0377 | J_(16) | 6,273,768 | 38.03 |
| Satt693 | J_(16) | 6,273,768 | 38.03 |
| BARC-018889-03032 | J_(16) | 6,474,327 | 38.62 |
| BARCSOYSSR_16_0424 | J_(16) | 7,054,261 | 40.67 |
| Sat_370 | J_(16) | 7,054,261 | 40.67 |
| BARC-028159-05778 | J_(16) | 7,070,781 | 41.63 |
| BARC-059919-16214 | J_(16) | 7,165,978 | 42.08 |

Figure 3B

| | | | |
|---|---|---|---|
| BARC-053335-11801 | J_(16) | 7,237,770 | 42.31 |
| BARC-048299-10543 | J_(16) | 7,446,239 | 43.04 |
| BARC-060769-16868 | J_(16) | 9,593,463 | 44.34 |
| BARC-058125-15101 | J_(16) | 10,818,091 | 44.60 |
| BARC-058115-15097 | J_(16) | 13,368,263 | 44.60 |
| BARC-058941-15515 | J_(16) | 14,534,998 | 44.60 |
| BARC-060857-16934 | J_(16) | 14,887,272 | 44.61 |
| BARC-056593-14514 | J_(16) | 15,091,717 | 44.61 |
| BARC-052587-11515 | J_(16) | 15,536,387 | 44.61 |
| BARC-062281-17737 | J_(16) | 16,322,634 | 44.61 |
| BARC-025801-05075 | J_(16) | 16,552,294 | 44.61 |
| BARC-059701-16014 | J_(16) | 19,326,141 | 44.61 |
| BARC-038343-10046 | J_(16) | 19,423,620 | 44.61 |
| BARC-013151-01456 | J_(16) | 20,512,221 | 44.61 |
| BARC-010869-00787 | J_(16) | 21,152,273 | 44.61 |
| BARC-051521-11150 | J_(16) | 21,264,807 | 44.61 |
| BARCSOYSSR_16_0703 | J_(16) | 23,096,039 | 45.66 |
| Satt529 | J_(16) | 23,096,039 | 45.66 |
| BARC-059377-15777 | J_(16) | 25,697,824 | 46.05 |
| BARCSOYSSR_16_0803 | J_(16) | 26,813,827 | 46.10 |
| Sat_165 | J_(16) | 26,813,827 | 46.10 |
| BARCSOYSSR_16_0840 | J_(16) | 27,633,714 | 46.11 |
| Satt622 | J_(16) | 27,633,714 | 46.11 |
| BARCSOYSSR_16_0885 | J_(16) | 28,589,375 | 47.36 |
| Satt215 | J_(16) | 28,589,375 | 47.36 |
| BARC-029037-06053 | J_(16) | 29,156,483 | 51.57 |
| BARC-038949-07404 | J_(16) | 30,065,357 | 57.70 |
| BARC-059837-16121 | J_(16) | 30,151,468 | 58.39 |
| BARC-042193-08207 | J_(16) | 30,395,923 | 62.96 |
| BARC-032663-09006 | J_(16) | 30,962,138 | 65.78 |
| BARC-017697-03107 | J_(16) | 31,075,508 | 66.45 |
| BARC-024047-04716 | J_(16) | 31,105,844 | 66.47 |
| BARC-022077-04282 | J_(16) | 31,154,859 | 66.56 |
| BARC-014795-01662 | J_(16) | 31,155,317 | 66.56 |
| BARC-042895-08450 | J_(16) | 31,292,648 | 67.05 |
| BARC-043111-08534 | J_(16) | 31,461,544 | 67.48 |
| BARC-060179-16450 | J_(16) | 31,613,798 | 67.74 |
| BARC-011645-00322 | J_(16) | 31,635,367 | 67.90 |
| BARCSOYSSR_16_1073 | J_(16) | 31,795,061 | 68.81 |
| Sctt011 | J_(16) | 31,795,061 | 68.81 |
| BARC-010297-00580 | J_(16) | 31,996,027 | 69.90 |

Figure 3C

| | | | |
|---|---|---|---|
| BARC-017835-02393 | J_(16) | 32,526,995 | 71.32 |
| BARC-012971-00414 | J_(16) | 32,573,581 | 71.56 |
| BARC-024115-04764 | J_(16) | 32,962,414 | 71.92 |
| BARC-040393-07727 | J_(16) | 33,410,287 | 73.26 |
| BARC-025217-06463 | J_(16) | 33,513,918 | 73.90 |
| BARCSOYSSR_16_1165 | J_(16) | 33,538,157 | 74.90 |
| Satt547 | J_(16) | 33,538,157 | 74.90 |
| BARC-028589-05965 | J_(16) | 33,853,031 | 76.14 |
| BARC-053847-12078 | J_(16) | 34,475,602 | 77.27 |
| BARC-051715-11216 | J_(16) | 35,032,380 | 77.40 |
| BARC-045099-08885 | J_(16) | 35,208,435 | 78.97 |
| BARC-025851-05117 | J_(16) | 35,571,437 | 80.79 |
| BARC-044031-08587 | J_(16) | 35,587,464 | 81.41 |
| BARCSOYSSR_16_1234 | J_(16) | 35,718,507 | 82.03 |
| Satt431 | J_(16) | 35,718,507 | 82.03 |
| BARC-045133-08889 | J_(16) | 36,163,500 | 84.07 |
| BARC-015307-02272 | J_(16) | 36,221,550 | 84.76 |
| BARC-011625-00310 | J_(16) | 36,544,211 | 85.58 |
| S11682-1 | J_(16) | 36,563,064 | 85.69 |
| BARC-024229-04809 | J_(16) | 36,641,788 | 86.17 |
| S06863-1 | J_(16) | 36,692,217 | 86.53 |
| BARC-048135-10500 | J_(16) | 36,732,539 | 86.82 |
| S11652-1 | J_(16) | 36,775,973 | 86.95 |
| BARC-019219-03397 | J_(16) | 36,921,370 | 87.38 |
| BARC-030203-06832 | J_(16) | 37,108,010 | 87.58 |
| BARC-029163-06102 | J_(16) | 37,181,366 | 88.51 |
| S06864-1 | J_(16) | 37,262,813 | 88.83 |
| BARC-030817-06946 | J_(16) | 37,289,136 | 88.93 |
| S06865-1 | J_(16) | 37,377,161 | 89.27 |

Figure 4A

| Locus Name | LG | Physical | Genetic Consensus4.0 Positions |
|---|---|---|---|
| BARC-020027-04405 | G_(18) | 181,064 | 0.00 |
| BARC-052957-11678 | G_(18) | 187,414 | 0.00 |
| BARC-064665-18774 | G_(18) | 224,648 | 0.11 |
| BARC-043197-08552 | G_(18) | 305,200 | 0.92 |
| BARC-060195-16470 | G_(18) | 470,340 | 1.64 |
| BARC-018387-03171 | G_(18) | 488,479 | 7.01 |
| BARC-022431-04323 | G_(18) | 734,360 | 7.43 |
| BARC-020839-03962 | G_(18) | 981,378 | 8.12 |
| BARC-900558-00952 | G_(18) | 999,063 | 8.12 |
| BARC-049013-10791 | G_(18) | 1,277,303 | 8.39 |
| BARC-015371-01813 | G_(18) | 1,431,827 | 8.63 |
| BARCSOYSSR_18_0093 | G_(18) | 1,621,261 | 9.44 |
| Sat_210 | G_(18) | 1,621,261 | 9.44 |
| BARC-048245-10515 | G_(18) | 1,718,204 | 9.94 |
| BARC-G00219-00248 | G_(18) | 1,726,610 | 9.96 |
| BARCSOYSSR_18_0102 | G_(18) | 1,736,324 | 10.10 |
| Satt309 | G_(18) | 1,736,324 | 10.10 |
| BARC-012285-01798 | G_(18) | 1,945,192 | 11.01 |
| BARC-010917-01706 | G_(18) | 1,955,436 | 11.09 |
| BARC-012289-01799 | G_(18) | 1,957,590 | 11.12 |
| BARC-028299-05817 | G_(18) | 1,958,726 | 11.86 |
| BARC-061523-17249 | G_(18) | 1,979,049 | 12.10 |
| BARC-030055-06792 | G_(18) | 2,033,662 | 12.15 |
| BARC-025777-05064 | G_(18) | 2,296,490 | 12.92 |
| BARCSOYSSR_18_0142 | G_(18) | 2,409,497 | 13.98 |
| Sat_141 | G_(18) | 2,409,497 | 13.98 |
| BARC-004952-00267 | G_(18) | 2,664,887 | 14.20 |
| BARCSOYSSR_18_0158 | G_(18) | 2,665,098 | 14.70 |
| Satt610 | G_(18) | 2,665,098 | 14.70 |
| BARC-047665-10370 | G_(18) | 2,833,064 | 15.97 |
| BARC-047787-10396 | G_(18) | 2,853,047 | 16.14 |
| BARCSOYSSR_18_0177 | G_(18) | 3,162,740 | 17.19 |
| Satt570 | G_(18) | 3,162,740 | 17.19 |
| BARC-014395-01348 | G_(18) | 3,448,063 | 19.48 |
| BARCSOYSSR_18_0195 | G_(18) | 3,603,119 | 20.57 |
| AW734137 | G_(18) | 3,603,119 | 20.57 |
| BARC-003432-00279 | G_(18) | 3,643,846 | 21.48 |
| BARCSOYSSR_18_0250 | G_(18) | 4,692,375 | 22.22 |

Figure 4B

| | | | |
|---|---|---|---|
| Satt217 | G_(18) | 4,692,375 | 22.22 |
| BARCSOYSSR_18_0257 | G_(18) | 4,800,515 | 24.96 |
| Satt235 | G_(18) | 4,800,515 | 24.96 |
| BARCSOYSSR_18_0295 | G_(18) | 5,330,646 | 29.20 |
| Sat_315 | G_(18) | 5,330,646 | 29.20 |
| BARCSOYSSR_18_0305 | G_(18) | 5,470,147 | 31.02 |
| Sat_290 | G_(18) | 5,470,147 | 31.02 |
| BARCSOYSSR_18_0316 | G_(18) | 5,675,379 | 32.88 |
| Sat_131 | G_(18) | 5,675,379 | 32.88 |
| BARCSOYSSR_18_0324 | G_(18) | 5,890,285 | 35.43 |
| Satt324 | G_(18) | 5,890,285 | 35.43 |
| BARCSOYSSR_18_0348 | G_(18) | 6,169,586 | 36.97 |
| Sat_403 | G_(18) | 6,169,586 | 36.97 |
| BARC-040265-07700 | G_(18) | 7,275,891 | 39.86 |
| BARC-901121-00988 | G_(18) | 8,415,710 | 40.41 |
| BARC-063985-18522 | G_(18) | 8,791,883 | 40.41 |
| BARC-039993-07626 | G_(18) | 9,012,214 | 40.81 |
| BARCSOYSSR_18_0550 | G_(18) | 11,400,889 | 43.03 |
| Sat_308 | G_(18) | 11,400,889 | 43.03 |
| BARC-053419-11845 | G_(18) | 12,638,074 | 44.99 |
| BARC-056521-14449 | G_(18) | 14,167,067 | 47.51 |
| BARC-059783-16090 | G_(18) | 14,285,415 | 47.51 |
| BARC-054849-12183 | G_(18) | 14,335,308 | 47.51 |
| BARC-049885-09225 | G_(18) | 14,570,865 | 48.21 |
| BARC-064283-18606 | G_(18) | 14,893,358 | 48.21 |
| BARC-017647-02654 | G_(18) | 15,242,485 | 48.33 |
| BARC-059485-15839 | G_(18) | 15,676,568 | 48.95 |
| BARC-040485-07753 | G_(18) | 15,723,524 | 48.95 |
| BARC-018333-03580 | G_(18) | 16,483,354 | 50.04 |
| BARC-018333-03581 | G_(18) | 16,483,354 | 50.24 |
| BARC-019465-03616 | G_(18) | 16,505,062 | 50.88 |
| BARC-013677-01228 | G_(18) | 16,668,537 | 52.04 |
| BARC-061001-16998 | G_(18) | 16,797,216 | 52.04 |
| BARC-047404-12924 | G_(18) | 17,550,827 | 52.04 |
| BARC-046912-12782 | G_(18) | 17,553,931 | 52.04 |
| BARC-046994-12826 | G_(18) | 17,575,698 | 52.04 |
| BARC-046874-12778 | G_(18) | 17,592,240 | 52.04 |
| BARC-046872-12776 | G_(18) | 17,600,728 | 52.04 |
| BARC-046920-12786 | G_(18) | 17,603,029 | 52.04 |
| BARC-046930-12795 | G_(18) | 17,611,727 | 52.04 |
| BARC-046926-12788 | G_(18) | 17,626,176 | 52.04 |

Figure 4C

| | | | |
|---|---|---|---|
| BARC-046922-12787 | G_(18) | 17,630,432 | 52.04 |
| BARC-057295-14678 | G_(18) | 17,781,283 | 52.04 |
| BARC-020159-04488 | G_(18) | 17,925,069 | 52.04 |
| BARC-060837-16930 | G_(18) | 18,410,099 | 52.04 |
| BARC-058413-15279 | G_(18) | 20,526,141 | 53.38 |
| BARC-060825-16919 | G_(18) | 21,121,950 | 54.45 |
| BARC-047150-12874 | G_(18) | 21,364,220 | 54.45 |
| BARC-047112-12860 | G_(18) | 21,365,038 | 54.45 |
| BARC-047096-12838 | G_(18) | 21,384,584 | 54.45 |
| BARC-063705-18440 | G_(18) | 21,701,030 | 54.45 |
| BARC-055557-13432 | G_(18) | 21,724,083 | 54.45 |
| BARC-062097-17654 | G_(18) | 22,120,170 | 54.45 |
| BARCSOYSSR_18_0845 | G_(18) | 22,150,302 | 54.97 |
| Satt303 | G_(18) | 22,150,302 | 54.97 |
| BARC-060189-16468 | G_(18) | 22,483,339 | 55.60 |
| BARC-047504-12947 | G_(18) | 22,535,676 | 55.60 |
| BARC-061785-17386 | G_(18) | 22,585,948 | 55.60 |
| BARC-047502-12946 | G_(18) | 22,588,708 | 55.60 |
| BARC-047102-12842 | G_(18) | 22,603,647 | 55.60 |
| BARC-055855-13794 | G_(18) | 23,123,288 | 55.60 |
| BARC-061111-17050 | G_(18) | 24,129,395 | 55.60 |
| BARC-058369-15257 | G_(18) | 27,610,750 | 55.60 |
| BARC-060613-16749 | G_(18) | 27,931,082 | 55.60 |
| BARC-013825-01251 | G_(18) | 30,313,907 | 55.60 |
| BARC-061647-17305 | G_(18) | 31,080,816 | 55.60 |
| BARC-056139-14122 | G_(18) | 31,828,672 | 55.60 |
| BARC-059397-15790 | G_(18) | 33,110,626 | 55.60 |
| BARC-062783-18056 | G_(18) | 33,753,070 | 55.60 |
| BARC-030691-06926 | G_(18) | 34,178,194 | 55.60 |
| BARC-057565-14836 | G_(18) | 34,232,818 | 55.60 |
| BARC-056267-14204 | G_(18) | 36,963,309 | 55.60 |
| BARC-061197-17134 | G_(18) | 39,413,323 | 55.60 |
| BARC-051485-11122 | G_(18) | 39,512,471 | 55.60 |
| BARC-014783-01660 | G_(18) | 41,560,487 | 55.60 |
| BARC-061717-17358 | G_(18) | 41,730,041 | 55.60 |
| BARC-044235-08650 | G_(18) | 42,206,429 | 55.60 |
| BARC-059239-15686 | G_(18) | 43,529,731 | 56.18 |
| BARC-056035-13999 | G_(18) | 45,468,441 | 56.71 |
| BARC-050493-09699 | G_(18) | 45,951,229 | 56.82 |
| BARCSOYSSR_18_1146 | G_(18) | 46,265,580 | 57.07 |
| Satt533 | G_(18) | 46,265,580 | 57.07 |

Figure 4D

| | | | |
|---|---|---|---|
| BARCSOYSSR_18_1210 | G_(18) | 48,532,689 | 57.82 |
| Satt504 | G_(18) | 48,532,689 | 57.82 |
| BARCSOYSSR_18_1348 | G_(18) | 52,189,343 | 59.89 |
| Sat_185 | G_(18) | 52,189,343 | 59.89 |
| BARCSOYSSR_18_1349 | G_(18) | 52,210,836 | 59.90 |
| Sat_203 | G_(18) | 52,210,836 | 59.90 |
| BARCSOYSSR_18_1364 | G_(18) | 52,465,758 | 60.60 |
| Satt199 | G_(18) | 52,465,758 | 60.60 |
| BARCSOYSSR_18_1385 | G_(18) | 52,746,490 | 60.97 |
| Sat_260 | G_(18) | 52,746,490 | 60.97 |
| BARCSOYSSR_18_1418 | G_(18) | 53,445,942 | 63.44 |
| Satt012 | G_(18) | 53,445,942 | 63.44 |
| BARC-056635-14538 | G_(18) | 53,471,513 | 63.92 |
| BARCSOYSSR_18_1426 | G_(18) | 53,656,489 | 65.78 |
| Sat_164 | G_(18) | 53,656,489 | 65.78 |
| BARCSOYSSR_18_1431 | G_(18) | 53,769,539 | 66.39 |
| Satt517 | G_(18) | 53,769,539 | 66.39 |
| BARC-027694-06635 | G_(18) | 54,764,508 | 67.91 |
| BARC-050613-09770 | G_(18) | 54,942,320 | 69.50 |
| BARC-024489-04936 | G_(18) | 55,001,002 | 70.62 |
| BARC-055139-13077 | G_(18) | 55,458,709 | 71.46 |
| BARC-061783-18883 | G_(18) | 55,506,257 | 72.02 |
| BARC-048761-10703 | G_(18) | 56,086,706 | 72.84 |
| BARC-016867-02359 | G_(18) | 56,429,486 | 73.34 |
| BARC-018441-03188 | G_(18) | 56,429,542 | 73.80 |
| BARC-052045-11324 | G_(18) | 57,071,922 | 75.00 |
| BARC-026013-05225 | G_(18) | 57,185,832 | 75.64 |
| BARC-015063-02553 | G_(18) | 57,353,963 | 76.88 |
| BARC-008223-00022 | G_(18) | 57,436,269 | 78.05 |
| BARC-032277-08935 | G_(18) | 57,462,526 | 79.40 |
| BARC-041705-08069 | G_(18) | 57,781,784 | 80.96 |
| BARC-032785-09037 | G_(18) | 57,781,833 | 80.96 |
| BARCSOYSSR_18_1703 | G_(18) | 58,093,491 | 85.66 |
| Sct_199 | G_(18) | 58,093,491 | 85.66 |
| BARCSOYSSR_18_1708 | G_(18) | 58,136,286 | 85.98 |
| Satt472 | G_(18) | 58,136,286 | 85.98 |
| BARC-048095-10484 | G_(18) | 58,177,377 | 86.59 |
| BARC-038873-07372 | G_(18) | 58,438,994 | 87.30 |
| BARCSOYSSR_18_1750 | G_(18) | 58,722,839 | 89.37 |
| Satt191 | G_(18) | 58,722,839 | 89.37 |
| BARCSOYSSR_18_1767 | G_(18) | 58,879,563 | 91.08 |

Figure 4E

| Sat_117 | G_(18) | 58,879,563 | 91.08 |
|---|---|---|---|
| BARC-010491-00654 | G_(18) | 59,279,444 | 93.00 |
| BARC-010495-00656 | G_(18) | 59,283,702 | 93.23 |
| BARC-024251-04812 | G_(18) | 59,472,425 | 94.30 |
| BARC-020069-04425 | G_(18) | 59,797,088 | 96.31 |
| BARC-062677-18004 | G_(18) | 59,995,654 | 97.32 |
| BARC-062769-18043 | G_(18) | 60,441,813 | 100.16 |
| BARCSOYSSR_18_1853 | G_(18) | 60,463,067 | 100.37 |
| Sct_187 | G_(18) | 60,463,067 | 100.37 |
| BARC-044363-08678 | G_(18) | 60,487,624 | 100.44 |
| BARCSOYSSR_18_1858 | G_(18) | 60,612,599 | 101.82 |
| Sat_064 | G_(18) | 60,612,599 | 101.82 |
| S08442-1 | G_(18) | 60,745,556 | 102.18 |
| S08341-1 | G_(18) | 60,777,850 | 102.27 |
| BARC-054735-12156 | G_(18) | 60,802,269 | 102.33 |
| BARC-013647-01216 | G_(18) | 60,909,921 | 103.22 |
| BARC-055537-13406 | G_(18) | 61,041,397 | 103.40 |
| BARC-039397-07314 | G_(18) | 61,188,102 | 103.55 |
| BARC-043995-08576 | G_(18) | 61,306,670 | 104.09 |
| BARC-064703-18782 | G_(18) | 61,480,202 | 105.53 |
| BARC-049989-09280 | G_(18) | 61,591,089 | 105.85 |
| BARC-017669-03102 | G_(18) | 62,046,576 | 107.09 |
| BARC-013305-00475 | G_(18) | 62,259,025 | 107.09 |

GENETIC LOCI ASSOCIATED WITH *PHYTOPHTHORA* TOLERANCE IN SOYBEAN AND METHODS OF USE

CROSS-REFERENCE TO RELATED APPLICATIONS

This application claims the benefit of U.S. Provisional Application No. 61/740,262, filed Dec. 20, 2012, which is hereby incorporated herein in its entirety by reference.

FIELD OF THE INVENTION

This invention relates to methods of identifying and/or selecting soybean plants or germplasm that display tolerance or improved tolerance to *Phytophthora* infection.

REFERENCE TO A SEQUENCE LISTING SUBMITTED AS A TEXT FILE VIA EFS-WEB

The official copy of the sequence listing is submitted concurrently with the specification as a text file via EFS-Web, in compliance with the American Standard Code for Information Interchange (ASCII), with a file name of 429546seqlist.txt, a creation date of Feb. 18, 2013 and a size of 785 KB. The sequence listing filed via EFS-Web is part of the specification and is hereby incorporated in its entirety by reference herein.

BACKGROUND

Soybeans (*Glycine max* L. Merr.) are a major cash crop and investment commodity in North America and elsewhere. Soybean oil is one of the most widely used edible oils, and soybeans are used worldwide both in animal feed and in human food production. Additionally, soybean utilization is expanding to industrial, manufacturing, and pharmaceutical applications.

*Phytophthora* is a major soybean fungal pathogen that induces stem and root rot in infected plants, causing severe losses in soybean viability and overall yield. *Phytophthora* root rot is caused by a pathogenic infection of *Phytophthora sojae*. Resistance to *Phytophthora* infection is conditioned by naturally occurring variation at the Resistance to *Phytophthora sojae* (Rps) loci. As races of *Phytophthora* in the fields shift, previously effective resistance sources are breaking down, causing damage and compromised yields in grower fields.

There remains a need for soybean plants with tolerance or improved tolerance to *Phytophthora* infection and methods for identifying and selecting such plants.

SUMMARY

Various methods and compositions are provided for identifying and/or selecting soybean plants or soybean germplasm with tolerance or improved tolerance to *Phytophthora* infection. In certain embodiments, the method comprises detecting at least one marker locus that is associated with tolerance to *Phytophthora* infection. In other embodiments, the method further comprises detecting at least one marker profile or haplotype associated with tolerance to *Phytophthora* infection. In further embodiments, the method comprises crossing a selected soybean plant with a second soybean plant. Further provided are markers, primers, probes and kits useful for identifying and/or selecting soybean plants or soybean germplasm with tolerance or improved tolerance to *Phytophthora* infection.

BRIEF DESCRIPTION OF THE FIGURES

FIG. 1 A-C provides a genetic map for loci on linkage group (LG) N.
FIG. 2 A-D provides a genetic map for loci on LG F.
FIG. 3 A-C provides a genetic map for loci on LG J.
FIG. 4 A-E provides a genetic map for loci on LG G.

DETAILED DESCRIPTION

Before describing the present invention in detail, it is to be understood that this invention is not limited to particular embodiments, which can, of course, vary. It is also to be understood that the terminology used herein is for the purpose of describing particular embodiments only, and is not intended to be limiting.

Certain definitions used in the specification and claims are provided below. In order to provide a clear and consistent understanding of the specification and claims, including the scope to be given such terms, the following definitions are provided:

As used in this specification and the appended claims, terms in the singular and the singular forms "a," "an," and "the," for example, include plural referents unless the content clearly dictates otherwise. Thus, for example, reference to "plant," "the plant," or "a plant" also includes a plurality of plants; also, depending on the context, use of the term "plant" can also include genetically similar or identical progeny of that plant; use of the term "a nucleic acid" optionally includes, as a practical matter, many copies of that nucleic acid molecule; similarly, the term "probe" optionally (and typically) encompasses many similar or identical probe molecules.

Additionally, as used herein, "comprising" is to be interpreted as specifying the presence of the stated features, integers, steps, or components as referred to, but does not preclude the presence or addition of one or more features, integers, steps, or components, or groups thereof. Thus, for example, a kit comprising one pair of oligonucleotide primers may have two or more pairs of oligonucleotide primers. Additionally, the term "comprising" is intended to include examples encompassed by the terms "consisting essentially of" and "consisting of." Similarly, the term "consisting essentially of" is intended to include examples encompassed by the term "consisting of."

"Agronomics," "agronomic traits," and "agronomic performance" refer to the traits (and underlying genetic elements) of a given plant variety that contribute to yield over the course of a growing season. Individual agronomic traits include emergence vigor, vegetative vigor, stress tolerance, disease resistance or tolerance, insect resistance or tolerance, herbicide resistance, branching, flowering, seed set, seed size, seed density, standability, threshability, and the like.

"Allele" means any of one or more alternative forms of a genetic sequence. In a diploid cell or organism, the two alleles of a given sequence typically occupy corresponding loci on a pair of homologous chromosomes. With regard to a SNP marker, allele refers to the specific nucleotide base present at that SNP locus in that individual plant.

The term "amplifying" in the context of nucleic acid amplification is any process whereby additional copies of a selected nucleic acid (or a transcribed form thereof) are produced. An "amplicon" is an amplified nucleic acid, e.g., a nucleic acid that is produced by amplifying a template nucleic acid by any available amplification method.

An "ancestral line" is a parent line used as a source of genes, e.g., for the development of elite lines.

An "ancestral population" is a group of ancestors that have contributed the bulk of the genetic variation that was used to develop elite lines.

"Backcrossing" is a process in which a breeder crosses a progeny variety back to one of the parental genotypes one or more times.

The term "chromosome segment" designates a contiguous linear span of genomic DNA that resides in planta on a single chromosome. "Chromosome interval" refers to a chromosome segment defined by specific flanking marker loci.

"Cultivar" and "variety" are used synonymously and mean a group of plants within a species (e.g., *Glycine max*) that share certain genetic traits that separate them from other possible varieties within that species. Soybean cultivars are inbred lines produced after several generations of self-pollinations. Individuals within a soybean cultivar are homogeneous, nearly genetically identical, with most loci in the homozygous state.

An "elite line" is an agronomically superior line that has resulted from many cycles of breeding and selection for superior agronomic performance. Numerous elite lines are available and known to those of skill in the art of soybean breeding.

An "elite population" is an assortment of elite individuals or lines that can be used to represent the state of the art in terms of agronomically superior genotypes of a given crop species, such as soybean.

An "exotic soybean strain" or an "exotic soybean germplasm" is a strain or germplasm derived from a soybean not belonging to an available elite soybean line or strain of germplasm. In the context of a cross between two soybean plants or strains of germplasm, an exotic germplasm is not closely related by descent to the elite germplasm with which it is crossed. Most commonly, the exotic germplasm is not derived from any known elite line of soybean, but rather is selected to introduce novel genetic elements (typically novel alleles) into a breeding program.

A "genetic map" is a description of genetic association or linkage relationships among loci on one or more chromosomes (or linkage groups) within a given species, generally depicted in a diagrammatic or tabular form.

"Genotype" is a description of the allelic state at one or more loci.

"Germplasm" means the genetic material that comprises the physical foundation of the hereditary qualities of an organism. As used herein, germplasm includes seeds and living tissue from which new plants may be grown; or, another plant part, such as leaf, stem, pollen, or cells, that may be cultured into a whole plant. Germplasm resources provide sources of genetic traits used by plant breeders to improve commercial cultivars.

An individual is "homozygous" if the individual has only one type of allele at a given locus (e.g., a diploid individual has a copy of the same allele at a locus for each of two homologous chromosomes). An individual is "heterozygous" if more than one allele type is present at a given locus (e.g., a diploid individual with one copy each of two different alleles). The term "homogeneity" indicates that members of a group have the same genotype at one or more specific loci. In contrast, the term "heterogeneity" is used to indicate that individuals within the group differ in genotype at one or more specific loci.

"Introgression" means the entry or introduction of a gene, QTL, haplotype, marker profile, trait, or trait locus from the genome of one plant into the genome of another plant.

The terms "label" or "detectable label" refer to a molecule capable of detection. A detectable label can also include a combination of a reporter and a quencher, such as are employed in FRET probes or TaqMan™ probes. The term "reporter" refers to a substance or a portion thereof which is capable of exhibiting a detectable signal, which signal can be suppressed by a quencher. The detectable signal of the reporter is, e.g., fluorescence in the detectable range. The term "quencher" refers to a substance or portion thereof which is capable of suppressing, reducing, inhibiting, etc., the detectable signal produced by the reporter. As used herein, the terms "quenching" and "fluorescence energy transfer" refer to the process whereby, when a reporter and a quencher are in close proximity, and the reporter is excited by an energy source, a substantial portion of the energy of the excited state non-radiatively transfers to the quencher where it either dissipates non-radiatively or is emitted at a different emission wavelength than that of the reporter.

A "line" or "strain" is a group of individuals of identical parentage that are generally inbred to some degree and that are generally homozygous and homogeneous at most loci (isogenic or near isogenic). A "subline" refers to an inbred subset of descendants that are genetically distinct from other similarly inbred subsets descended from the same progenitor. Traditionally, a subline has been derived by inbreeding the seed from an individual soybean plant selected at the F3 to F5 generation until the residual segregating loci are "fixed" or homozygous across most or all loci. Commercial soybean varieties (or lines) are typically produced by aggregating ("bulking") the self-pollinated progeny of a single F3 to F5 plant from a controlled cross between 2 genetically different parents. While the variety typically appears uniform, the self-pollinating variety derived from the selected plant eventually (e.g., F8) becomes a mixture of homozygous plants that can vary in genotype at any locus that was heterozygous in the originally selected F3 to F5 plant. Marker-based sublines that differ from each other based on qualitative polymorphism at the DNA level at one or more specific marker loci are derived by genotyping a sample of seed derived from individual self-pollinated progeny derived from a selected F3-F5 plant. The seed sample can be genotyped directly as seed, or as plant tissue grown from such a seed sample. Optionally, seed sharing a common genotype at the specified locus (or loci) are bulked providing a subline that is genetically homogenous at identified loci important for a trait of interest (e.g., yield, tolerance, etc.).

"Linkage" refers to the tendency for alleles to segregate together more often than expected by chance if their transmission was independent. Typically, linkage refers to alleles on the same chromosome. Genetic recombination occurs with an assumed random frequency over the entire genome. Genetic maps are constructed by measuring the frequency of recombination between pairs of traits or markers, the lower the frequency of recombination, and the greater the degree of linkage.

"Linkage disequilibrium" is a non-random association of alleles at two or more loci and can occur between unlinked markers. It is based on allele frequencies within a population and is influenced by but not dependent on linkage.

"Linkage group" (LG) refers to traits or markers that generally co-segregate. A linkage group generally corresponds to a chromosomal region containing genetic material that encodes the traits or markers.

"Locus" is a defined segment of DNA.

A "map location" or "map position" is an assigned location on a genetic map relative to linked genetic markers where a specified marker can be found within a given species. Map positions are generally provided in centimorgans (cM), unless otherwise indicated, genetic positions provided are based on the *Glycine max* consensus map v 4.0 as provided by Hyten et al. (2010) Crop Sci 50:960-968. A "physical position" or "physical location" or "physical map location" is the position, typically in nucleotides bases, of a particular nucleotide, such as a SNP nucleotide, on a chromosome. Unless otherwise indicated, the physical position within the soybean genome provided is based on the Glyma 1.0 genome sequence described in Schmutz et al. (2010) Nature 463:178-183, available from the Phytozome website (phytozome-dot-net/soybean).

"Mapping" is the process of defining the association and relationships of loci through the use of genetic markers, populations segregating for the markers, and standard genetic principles of recombination frequency.

"Marker" or "molecular marker" or "marker locus" is a term used to denote a nucleic acid or amino acid sequence that is sufficiently unique to characterize a specific locus on the genome. Any detectable polymorphic trait can be used as a marker so long as it is inherited differentially and exhibits linkage disequilibrium with a phenotypic trait of interest.

"Marker assisted selection" refers to the process of selecting a desired trait or traits in a plant or plants by detecting one or more nucleic acids from the plant, where the nucleic acid is linked to the desired trait, and then selecting the plant or germplasm possessing those one or more nucleic acids.

"Haplotype" refers to a combination of particular alleles present within a particular plant's genome at two or more linked marker loci, for instance at two or more loci on a particular linkage group. For instance, in one example, two specific marker loci on LG-N are used to define a haplotype for a particular plant. In still further examples, 3, 4, 5, 6, 7, 8, 9, 10, 11, 12, 13, 14, 15, 16, 17, 18, 19, 20, or more linked marker loci are used to define a haplotype for a particular plant.

As used herein, a "marker profile" means a combination of particular alleles present within a particular plant's genome at two or more marker loci which are not linked, for instance two or more loci on two or more different linkage groups or two or more chromosomes. For instance, in one example, a particular combination of marker loci or a particular combination of haplotypes define the marker profile of a particular plant.

The term "plant" includes reference to an immature or mature whole plant, including a plant from which seed or grain or anthers have been removed. Seed or embryo that will produce the plant is also considered to be the plant.

"Plant parts" means any portion or piece of a plant, including leaves, stems, buds, roots, root tips, anthers, seed, grain, embryo, pollen, ovules, flowers, cotyledons, hypocotyls, pods, flowers, shoots, stalks, tissues, tissue cultures, cells and the like.

"Polymorphism" means a change or difference between two related nucleic acids. A "nucleotide polymorphism" refers to a nucleotide that is different in one sequence when compared to a related sequence when the two nucleic acids are aligned for maximal correspondence.

"Polynucleotide," "polynucleotide sequence," "nucleic acid," "nucleic acid molecule," "nucleic acid sequence," "nucleic acid fragment," and "oligonucleotide" are used interchangeably herein to indicate a polymer of nucleotides that is single- or multi-stranded, that optionally contains synthetic, non-natural, or altered RNA or DNA nucleotide bases. A DNA polynucleotide may be comprised of one or more strands of cDNA, genomic DNA, synthetic DNA, or mixtures thereof.

"Primer" refers to an oligonucleotide which is capable of acting as a point of initiation of nucleic acid synthesis or replication along a complementary strand when placed under conditions in which synthesis of a complementary strand is catalyzed by a polymerase. Typically, primers are about 10 to 30 nucleotides in length, but longer or shorter sequences can be employed. Primers may be provided in double-stranded form, though the single-stranded form is more typically used. A primer can further contain a detectable label, for example a 5' end label.

"Probe" refers to an oligonucleotide that is complementary (though not necessarily fully complementary) to a polynucleotide of interest and forms a duplexed structure by hybridization with at least one strand of the polynucleotide of interest. Typically, probes are oligonucleotides from 10 to 50 nucleotides in length, but longer or shorter sequences can be employed. A probe can further contain a detectable label.

"Quantitative trait loci" or "QTL" refer to the genetic elements controlling a quantitative trait.

"Recombination frequency" is the frequency of a crossing over event (recombination) between two genetic loci. Recombination frequency can be observed by following the segregation of markers and/or traits during meiosis.

"Tolerance and "improved tolerance" are used interchangeably herein and refer to any type of increase in resistance or tolerance to, or any type of decrease in susceptibility. A "tolerant plant" or "tolerant plant variety" need not possess absolute or complete tolerance. Instead, a "tolerant plant," "tolerant plant variety," or a plant or plant variety with "improved tolerance" will have a level of resistance or tolerance which is higher than that of a comparable susceptible plant or variety.

"Self-crossing" or "self-pollination" or "selfing" is a process through which a breeder crosses a plant with itself; for example, a second generation hybrid F2 with itself to yield progeny designated F2:3.

"SNP" or "single nucleotide polymorphism" means a sequence variation that occurs when a single nucleotide (A, T, C, or G) in the genome sequence is altered or variable. "SNP markers" exist when SNPs are mapped to sites on the soybean genome.

The term "yield" refers to the productivity per unit area of a particular plant product of commercial value. For example, yield of soybean is commonly measured in bushels of seed per acre or metric tons of seed per hectare per season. Yield is affected by both genetic and environmental factors.

As used herein, an "isolated" or "purified" polynucleotide or polypeptide, or biologically active portion thereof, is substantially or essentially free from components that normally accompany or interact with the polynucleotide or polypeptide as found in its naturally occurring environment. Typically, an "isolated" polynucleotide is free of sequences (optimally protein encoding sequences) that naturally flank the polynucleotide (i.e., sequences located at the 5' and 3' ends of the polynucleotide) in the genomic DNA of the organism from which the polynucleotide is derived. For example, the isolated polynucleotide can contain less than about 5 kb, 4 kb, 3 kb, 2 kb, 1 kb, 0.5 kb, or 0.1 kb of nucleotide sequence that naturally flank the polynucleotide in genomic DNA of the cell from which the polynucleotide is derived. A polypeptide that is substantially free of cellular material includes preparations of polypeptides having less than about 30%, 20%, 10%, 5%, or 1% (by dry weight) of contaminating protein culture media or other chemical components.

Standard recombinant DNA and molecular cloning techniques used herein are well known in the art and are described more fully in Sambrook, J., Fritsch, E. F. and Maniatis, T. Molecular Cloning: A Laboratory Manual; Cold Spring Harbor Laboratory Press: Cold Spring Harbor, 1989 (hereinafter "Sambrook").

Methods are provided for identifying and/or selecting a soybean plant or soybean germplasm that displays tolerance or improved tolerance to *Phytophthora* infection. The method comprises detecting in the soybean plant or germplasm, or a part thereof, at least one marker locus associated with tolerance to *Phytophthora* infection. Also provided are isolated polynucleotides and kits for use in identifying and/or detecting a soybean plant or soybean germplasm that displays tolerance or improved tolerance to *Phytophthora* infection, and soybean plants, cells, and/or seeds comprising at least one marker locus conferring improved tolerance to *Phytophthora*.

Provided herein, marker loci associated with tolerance to *Phytophthora* infection have been identified and mapped to genomic loci on linkage groups F, G, J and N.

The marker loci provided herein are associated with various *Phytophthora* multi-race resistance genes. In some embodiments, the marker loci are associated with the Rps1a, Rps1c, Rps1d or Rps1k loci on linkage group N. In another embodiment, the marker loci are associated with the Rps2 locus on linkage group J. In other embodiments, the marker loci are associated with the Rps1a or Rps1c loci on linkage group F. In yet another embodiment, the marker loci are associated with the Rps6 loci on linkage group G.

These findings have important implications for soybean production, as identifying markers that can be used for selection of *Phytophthora* tolerance will greatly expedite the development of *Phytophthora* tolerance into elite cultivars.

Marker loci, haplotypes and marker profiles associated with tolerance or improved tolerance to *Phytophthora* infection, are provided. Further provided are genomic loci that are associated with soybean tolerance or improved tolerance to *Phytophthora*.

In certain embodiments, soybean plants or germplasm are identified that have at least one favorable allele, marker locus, haplotype or marker profile that positively correlates with tolerance or improved tolerance to *Phytophthora* infection. However, in other embodiments, it is useful for exclusionary purposes during breeding to identify alleles, marker loci, haplotypes, or marker profiles that negatively correlate with tolerance, for example, to eliminate such plants or germplasm from subsequent rounds of breeding.

In one embodiment, marker loci useful for identifying a first soybean plant or first soybean germplasm that displays tolerance or improved tolerance to *Phytophthora* infection are associated with the Rps1a, Rps1c or Rps1d loci on linkage group N. In a specific embodiment, the marker locus comprises one or more of S08291-1, S07292-1, S08242-1, S16592-001 or a marker closely linked thereto on linkage group N.

In another embodiment, marker loci useful for identifying a first soybean plant or first soybean germplasm that displays tolerance or improved tolerance to *Phytophthora* infection are associated with the Rps1k locus on linkage group N. In a specific embodiment, the marker locus comprises one or more of S07963-2, S07372-1, 500009-01, S08013-1, any of the Rps1k marker loci in Table 1B or a marker closely linked thereto on linkage group N.

In another embodiment, marker loci useful for identifying a first soybean plant or first soybean germplasm that displays tolerance or improved tolerance to *Phytophthora* infection are associated with the Rps2 locus on linkage group J. In a specific embodiment, the marker locus comprises one or more of S06862-1, S06863-1, S06864-1, S06865-1, S11652-1, S11682-1 or a marker closely linked thereto on linkage group J.

In another embodiment, marker loci useful for identifying a first soybean plant or first soybean germplasm that displays tolerance or improved tolerance to *Phytophthora* infection are associated with the Rps3a or Rps3c loci on linkage group F. In a specific embodiment, the marker locus comprises one or more of S09018-1, S08342-1, S07163-1 or a marker closely linked thereto on linkage group F.

In another embodiment, marker loci useful for identifying a first soybean plant or first soybean germplasm that displays tolerance or improved tolerance to *Phytophthora* infection are associated with the Rps6 locus on linkage group G. In a specific embodiment, the marker locus comprises one or more of S08442-1, S08341-1 or a marker closely linked thereto on linkage group G.

Non-limiting examples of marker loci located within, linked to, or closely linked to these genomic loci are provided in Tables 1A and 1B and in FIG. 1 A-C, FIG. 2 A-D, FIG. 3 A-C and FIG. 4 A-D.

TABLE 1A

| Marker ID | Gene/Locus | Linkage Group | Flanking Public Markers* | Region (CM)* | Genetic (cM)* | Physical Position Region** | Physical Position** | Allele (R/S) | Source |
| --- | --- | --- | --- | --- | --- | --- | --- | --- | --- |
| S08291-1 | Rps1a | N | satt009 | | 22.58 | | 3905604 | G/A | |
| S07292-1 | Rps1c | N | satt641 | | 23.17 | | 4464524 | T/G | |
| S08242-1 | Rps1c | N | | | 23.05 | | 4343399 | C/T | Arksoy |
| S16592-001 | Rps1d | N | | | 22.58 | 3927035-37377161 | 3904033 | A/T | |
| S07963-2 | Rps1k | N | satt009 | | 22.63 | | 3951705 | T/C | |
| S07372-1 | Rps1k | N | satt530 | | 24.46 | | 5227883 | C/T | |
| S00009-01 | Rps1k | N | satt009 | | 22.61 | | 3927056 | C/T | Kingwa |
| S08013-1 | Rps1k | N | | | 23.17 | | 4458273 | C/T | |
| S06862-1 | Rps2 | J | satt431 | 81-90 | 83.71 | 36085130-37377161 | 36085130 | T/G | CNS, L76-1988 |
| S06863-1 | Rps2 | J | | 81-90 | 86.53 | 36085130-37377161 | 36692217 | G/A | CNS, L76-1988 |
| S06864-1 | Rps2 | J | | 81-90 | 88.83 | 36085130-37377161 | 37262813 | T/C | CNS, L76-1988 |
| S06865-1 | Rps2 | J | | 81-90 | 89.27 | 36085130-37377161 | 37377161 | G/A | CNS, L76-1988 |

TABLE 1A-continued

| Marker ID | Gene/Locus | Linkage Group | Flanking Public Markers* | Region (CM)* | Genetic (cM)* | Physical Position Region** | Physical Position** | Allele (R/S) | Source |
|---|---|---|---|---|---|---|---|---|---|
| S11652-1 | Rps2 | J | sat_395 | 81-90 | 86.95 | 36085130-37377161 | 36775973 | G/T | CNS, L76-1988 |
| S11682-1 | Rps2 | J | sat_395 | 81-90 | 85.69 | 36085130-37377161 | 36563064 | G/T | CNS, L76-1988 |
| S09018-1 | Rps3a | F | satt334 | | 51.85 | | 29110641 | C/G | PI171442 |
| S08342-1 | Rps3a | F | | | 51.79 | | 29049150 | [T/A]/[T/C]/[C/A] | PI171442 |
| S07163-1 | Rps3c | F | satt334 | | 51.79 | | 29049184 | T/C | PI340046 |
| S08442-1 | Rps6 | G | sat_064 | | 102.18 | | 60745556 | T/C | Archer |
| S08341-1 | Rps6 | G | | | 102.27 | | 60777851 | [A/T]/[G/T] | Archer |

*Gm composite 2003 Genetic Map
**Physical postions are based on Public JGI Glymal Williams82 reference.

TABLE 1B

| Marker ID | Locus | LG | Physical Position | Allele [R/S] | Source |
|---|---|---|---|---|---|
| Gm03:3915646 | Rps1k | N | 3915646 | [A/T] | Kingwa |
| Gm03:3917778 | Rps1k | N | 3917778 | [A/C] | Kingwa |
| Gm03:3918853 | Rps1k | N | 3918853 | [T/C] | Kingwa |
| Gm03:3920367 | Rps1k | N | 3920367 | [A/G] | Kingwa |
| Gm03:3926721 | Rps1k | N | 3926721 | [T/G] | Kingwa |
| Gm03:3926775 | Rps1k | N | 3926775 | [A/G] | Kingwa |
| Gm03:3927474 | Rps1k | N | 3927474 | [T/A] | Kingwa |
| Gm03:3927724 | Rps1k | N | 3927724 | [G/T] | Kingwa |
| Gm03:3929330 | Rps1k | N | 3929330 | [A/G] | Kingwa |
| Gm03:3929383 | Rps1k | N | 3929383 | [A/G] | Kingwa |
| Gm03:3930408 | Rps1k | N | 3930408 | [A/C] | Kingwa |
| Gm03:3930551 | Rps1k | N | 3930551 | [T/C] | Kingwa |
| Gm03:3930806 | Rps1k | N | 3930806 | [T/C] | Kingwa |
| Gm03:3932629 | Rps1k | N | 3932629 | [T/G] | Kingwa |
| Gm03:3932974 | Rps1k | N | 3932974 | [T/C] | Kingwa |
| Gm03:3933370 | Rps1k | N | 3933370 | [A/T] | Kingwa |
| Gm03:3933900 | Rps1k | N | 3933900 | [G/A] | Kingwa |
| Gm03:3933945 | Rps1k | N | 3933945 | [C/T] | Kingwa |
| Gm03:3934403 | Rps1k | N | 3934403 | [G/A] | Kingwa |
| Gm03:3934964 | Rps1k | N | 3934964 | [G/A] | Kingwa |
| Gm03:3935036 | Rps1k | N | 3935036 | [G/A] | Kingwa |
| Gm03:3935832 | Rps1k | N | 3935832 | [G/A] | Kingwa |
| Gm03:3935884 | Rps1k | N | 3935884 | [T/C] | Kingwa |
| Gm03:3939831 | Rps1k | N | 3939831 | [C/G] | Kingwa |
| Gm03:3939836 | Rps1k | N | 3939836 | [G/A] | Kingwa |
| Gm03:3939936 | Rps1k | N | 3939936 | [T/A] | Kingwa |
| Gm03:3939939 | Rps1k | N | 3939939 | [G/T] | Kingwa |
| Gm03:3940174 | Rps1k | N | 3940174 | [T/C] | Kingwa |
| Gm03:3940396 | Rps1k | N | 3940396 | [C/T] | Kingwa |
| Gm03:3940836 | Rps1k | N | 3940836 | [T/C] | Kingwa |
| Gm03:3941262 | Rps1k | N | 3941262 | [A/G] | Kingwa |
| Gm03:3941484 | Rps1k | N | 3941484 | [A/G] | Kingwa |
| Gm03:3941769 | Rps1k | N | 3941769 | [T/G] | Kingwa |
| Gm03:3942973 | Rps1k | N | 3942973 | [C/G] | Kingwa |
| Gm03:3943092 | Rps1k | N | 3943092 | [A/G] | Kingwa |
| Gm03:3944671 | Rps1k | N | 3944671 | [T/C] | Kingwa |
| Gm03:3944738 | Rps1k | N | 3944738 | [C/A] | Kingwa |
| Gm03:3945112 | Rps1k | N | 3945112 | [A/T] | Kingwa |
| Gm03:3945208 | Rps1k | N | 3945208 | [T/C] | Kingwa |
| Gm03:3947836 | Rps1k | N | 3947836 | [T/C] | Kingwa |
| Gm03:3947860 | Rps1k | N | 3947860 | [G/T] | Kingwa |
| Gm03:3949250 | Rps1k | N | 3949250 | [C/T] | Kingwa |
| Gm03:3949680 | Rps1k | N | 3949680 | [A/C] | Kingwa |
| Gm03:3951187 | Rps1k | N | 3951187 | [G/A] | Kingwa |
| Gm03:3951201 | Rps1k | N | 3951201 | [G/A] | Kingwa |
| Gm03:3951485 | Rps1k | N | 3951485 | [C/G] | Kingwa |
| Gm03:3951603 | Rps1k | N | 3951603 | [C/T] | Kingwa |
| Gm03:3951705 | Rps1k | N | 3951705 | [A/G] | Kingwa |
| Gm03:3951715 | Rps1k | N | 3951715 | [G/C] | Kingwa |
| Gm03:3952778 | Rps1k | N | 3952778 | [T/A] | Kingwa |
| Gm03:3952811 | Rps1k | N | 3952811 | [T/A] | Kingwa |
| Gm03:3955716 | Rps1k | N | 3955716 | [T/A] | Kingwa |
| Gm03:3956414 | Rps1k | N | 3956414 | [T/C] | Kingwa |
| Gm03:3958402 | Rps1k | N | 3958402 | [A/G] | Kingwa |
| Gm03:3960626 | Rps1k | N | 3960626 | [T/C] | Kingwa |
| Gm03:3962904 | Rps1k | N | 3962904 | [A/G] | Kingwa |
| Gm03:3967880 | Rps1k | N | 3967880 | [T/G] | Kingwa |
| Gm03:3968334 | Rps1k | N | 3968334 | [G/A] | Kingwa |
| Gm03:3971607 | Rps1k | N | 3971607 | [C/T] | Kingwa |
| Gm03:3971640 | Rps1k | N | 3971640 | [C/A] | Kingwa |
| Gm03:3971692 | Rps1k | N | 3971692 | [T/C] | Kingwa |
| Gm03:3975817 | Rps1k | N | 3975817 | [T/C] | Kingwa |
| Gm03:3975824 | Rps1k | N | 3975824 | [T/A] | Kingwa |
| Gm03:3976645 | Rps1k | N | 3976645 | [T/C] | Kingwa |
| Gm03:3980566 | Rps1k | N | 3980566 | [T/A] | Kingwa |
| Gm03:3981623 | Rps1k | N | 3981623 | [A/G] | Kingwa |
| Gm03:3981822 | Rps1k | N | 3981822 | [A/G] | Kingwa |
| Gm03:3982138 | Rps1k | N | 3982138 | [C/T] | Kingwa |
| Gm03:3982678 | Rps1k | N | 3982678 | [A/C] | Kingwa |
| Gm03:3984554 | Rps1k | N | 3984554 | [C/T] | Kingwa |
| Gm03:3986094 | Rps1k | N | 3986094 | [T/C] | Kingwa |
| Gm03:3987393 | Rps1k | N | 3987393 | [C/T] | Kingwa |
| Gm03:3990954 | Rps1k | N | 3990954 | [T/G] | Kingwa |
| Gm03:3992071 | Rps1k | N | 3992071 | [C/A] | Kingwa |
| Gm03:3995556 | Rps1k | N | 3995556 | [C/T] | Kingwa |
| Gm03:3996269 | Rps1k | N | 3996269 | [C/A] | Kingwa |
| Gm03:3996600 | Rps1k | N | 3996600 | [T/A] | Kingwa |
| Gm03:3997028 | Rps1k | N | 3997028 | [C/T] | Kingwa |
| Gm03:3998157 | Rps1k | N | 3998157 | [G/C] | Kingwa |
| Gm03:3998162 | Rps1k | N | 3998162 | [G/A] | Kingwa |
| Gm03:3998381 | Rps1k | N | 3998381 | [T/C] | Kingwa |
| Gm03:3998421 | Rps1k | N | 3998421 | [T/C] | Kingwa |
| Gm03:3999241 | Rps1k | N | 3999241 | [T/G] | Kingwa |
| Gm03:3999386 | Rps1k | N | 3999386 | [C/A] | Kingwa |
| Gm03:3999666 | Rps1k | N | 3999666 | [A/G] | Kingwa |
| Gm03:4000684 | Rps1k | N | 4000684 | [C/G] | Kingwa |
| Gm03:4001327 | Rps1k | N | 4001327 | [A/G] | Kingwa |
| Gm03:4001783 | Rps1k | N | 4001783 | [A/T] | Kingwa |
| Gm03:4002016 | Rps1k | N | 4002016 | [C/T] | Kingwa |
| Gm03:4005770 | Rps1k | N | 4005770 | [T/C] | Kingwa |
| Gm03:4008187 | Rps1k | N | 4008187 | [G/A] | Kingwa |
| Gm03:4008673 | Rps1k | N | 4008673 | [A/G] | Kingwa |
| Gm03:4008687 | Rps1k | N | 4008687 | [A/G] | Kingwa |
| Gm03:4010191 | Rps1k | N | 4010191 | [C/T] | Kingwa |
| Gm03:4018588 | Rps1k | N | 4018588 | [A/G] | Kingwa |
| Gm03:4019384 | Rps1k | N | 4019384 | [T/C] | Kingwa |
| Gm03:4019896 | Rps1k | N | 4019896 | [A/G] | Kingwa |
| Gm03:4020751 | Rps1k | N | 4020751 | [T/C] | Kingwa |
| Gm03:4021281 | Rps1k | N | 4021281 | [G/A] | Kingwa |
| Gm03:4021291 | Rps1k | N | 4021291 | [A/G] | Kingwa |
| Gm03:4022234 | Rps1k | N | 4022234 | [T/A] | Kingwa |
| Gm03:4022275 | Rps1k | N | 4022275 | [T/C] | Kingwa |
| Gm03:4022530 | Rps1k | N | 4022530 | [A/T] | Kingwa |
| Gm03:4022872 | Rps1k | N | 4022872 | [A/G] | Kingwa |
| Gm03:4022934 | Rps1k | N | 4022934 | [A/G] | Kingwa |
| Gm03:4023283 | Rps1k | N | 4023283 | [T/C] | Kingwa |

TABLE 1B-continued

| Marker ID | Locus | LG | Physical Position | Allele [R/S] | Source |
|---|---|---|---|---|---|
| Gm03:4023522 | Rps1k | N | 4023522 | [C/T] | Kingwa |
| Gm03:4024184 | Rps1k | N | 4024184 | [C/A] | Kingwa |
| Gm03:4024294 | Rps1k | N | 4024294 | [T/C] | Kingwa |
| Gm03:4024485 | Rps1k | N | 4024485 | [A/G] | Kingwa |
| Gm03:4024630 | Rps1k | N | 4024630 | [T/C] | Kingwa |
| Gm03:4024844 | Rps1k | N | 4024844 | [T/C] | Kingwa |
| Gm03:4025056 | Rps1k | N | 4025056 | [A/G] | Kingwa |
| Gm03:4026652 | Rps1k | N | 4026652 | [T/A] | Kingwa |
| Gm03:4028481 | Rps1k | N | 4028481 | [G/T] | Kingwa |
| Gm03:4028849 | Rps1k | N | 4028849 | [A/G] | Kingwa |
| Gm03:4028961 | Rps1k | N | 4028961 | [A/G] | Kingwa |
| Gm03:4029068 | Rps1k | N | 4029068 | [A/G] | Kingwa |
| Gm03:4029809 | Rps1k | N | 4029809 | [T/G] | Kingwa |
| Gm03:4031277 | Rps1k | N | 4031277 | [G/T] | Kingwa |
| Gm03:4031983 | Rps1k | N | 4031983 | [C/A] | Kingwa |
| Gm03:4031997 | Rps1k | N | 4031997 | [G/C] | Kingwa |
| Gm03:4032705 | Rps1k | N | 4032705 | [T/C] | Kingwa |
| Gm03:4035600 | Rps1k | N | 4035600 | [T/C] | Kingwa |
| Gm03:4035918 | Rps1k | N | 4035918 | [A/G] | Kingwa |
| Gm03:4036376 | Rps1k | N | 4036376 | [A/C] | Kingwa |
| Gm03:4040874 | Rps1k | N | 4040874 | [A/G] | Kingwa |
| Gm03:4041301 | Rps1k | N | 4041301 | [T/C] | Kingwa |
| Gm03:4041795 | Rps1k | N | 4041795 | [A/G] | Kingwa |
| Gm03:4042572 | Rps1k | N | 4042572 | [G/A] | Kingwa |
| Gm03:4042679 | Rps1k | N | 4042679 | [T/C] | Kingwa |
| Gm03:4042697 | Rps1k | N | 4042697 | [A/G] | Kingwa |
| Gm03:4043007 | Rps1k | N | 4043007 | [A/G] | Kingwa |
| Gm03:4043140 | Rps1k | N | 4043140 | [A/G] | Kingwa |
| Gm03:4043823 | Rps1k | N | 4043823 | [T/G] | Kingwa |
| Gm03:4043978 | Rps1k | N | 4043978 | [C/T] | Kingwa |
| Gm03:4044534 | Rps1k | N | 4044534 | [T/C] | Kingwa |
| Gm03:4044555 | Rps1k | N | 4044555 | [T/C] | Kingwa |
| Gm03:4044972 | Rps1k | N | 4044972 | [A/G] | Kingwa |
| Gm03:4045630 | Rps1k | N | 4045630 | [A/G] | Kingwa |
| Gm03:4046313 | Rps1k | N | 4046313 | [C/A] | Kingwa |
| Gm03:4049555 | Rps1k | N | 4049555 | [T/C] | Kingwa |
| Gm03:4049791 | Rps1k | N | 4049791 | [T/C] | Kingwa |
| Gm03:4049877 | Rps1k | N | 4049877 | [T/C] | Kingwa |
| Gm03:4050197 | Rps1k | N | 4050197 | [A/G] | Kingwa |
| Gm03:4053685 | Rps1k | N | 4053685 | [T/C] | Kingwa |
| Gm03:4053838 | Rps1k | N | 4053838 | [T/C] | Kingwa |
| Gm03:4054927 | Rps1k | N | 4054927 | [T/C] | Kingwa |
| Gm03:4055100 | Rps1k | N | 4055100 | [A/G] | Kingwa |
| Gm03:4055384 | Rps1k | N | 4055384 | [A/G] | Kingwa |
| Gm03:4055427 | Rps1k | N | 4055427 | [T/C] | Kingwa |
| Gm03:4055483 | Rps1k | N | 4055483 | [A/G] | Kingwa |
| Gm03:4062751 | Rps1k | N | 4062751 | [A/C] | Kingwa |
| Gm03:4062885 | Rps1k | N | 4062885 | [A/T] | Kingwa |
| Gm03:4064351 | Rps1k | N | 4064351 | [T/C] | Kingwa |
| Gm03:4064592 | Rps1k | N | 4064592 | [A/G] | Kingwa |
| Gm03:4064759 | Rps1k | N | 4064759 | [T/G] | Kingwa |
| Gm03:4064811 | Rps1k | N | 4064811 | [T/C] | Kingwa |
| Gm03:4064957 | Rps1k | N | 4064957 | [C/T] | Kingwa |
| Gm03:4065083 | Rps1k | N | 4065083 | [T/C] | Kingwa |
| Gm03:4066234 | Rps1k | N | 4066234 | [A/T] | Kingwa |
| Gm03:4066331 | Rps1k | N | 4066331 | [A/T] | Kingwa |
| Gm03:4067099 | Rps1k | N | 4067099 | [A/T] | Kingwa |
| Gm03:4067514 | Rps1k | N | 4067514 | [T/A] | Kingwa |
| Gm03:4069037 | Rps1k | N | 4069037 | [T/G] | Kingwa |
| Gm03:4069603 | Rps1k | N | 4069603 | [T/A] | Kingwa |
| Gm03:4070422 | Rps1k | N | 4070422 | [G/A] | Kingwa |
| Gm03:4072567 | Rps1k | N | 4072567 | [T/C] | Kingwa |
| Gm03:4074190 | Rps1k | N | 4074190 | [T/C] | Kingwa |
| Gm03:4075232 | Rps1k | N | 4075232 | [G/A] | Kingwa |
| Gm03:4076404 | Rps1k | N | 4076404 | [T/A] | Kingwa |
| Gm03:4078299 | Rps1k | N | 4078299 | [T/C] | Kingwa |
| Gm03:4078902 | Rps1k | N | 4078902 | [C/T] | Kingwa |
| Gm03:4080136 | Rps1k | N | 4080136 | [A/T] | Kingwa |
| Gm03:4081056 | Rps1k | N | 4081056 | [T/A] | Kingwa |
| Gm03:4081889 | Rps1k | N | 4081889 | [A/G] | Kingwa |
| Gm03:4082200 | Rps1k | N | 4082200 | [G/A] | Kingwa |
| Gm03:4082590 | Rps1k | N | 4082590 | [C/G] | Kingwa |
| Gm03:4082701 | Rps1k | N | 4082701 | [A/C] | Kingwa |
| Gm03:4082781 | Rps1k | N | 4082781 | [G/C] | Kingwa |
| Gm03:4082871 | Rps1k | N | 4082871 | [A/G] | Kingwa |
| Gm03:4083114 | Rps1k | N | 4083114 | [T/C] | Kingwa |
| Gm03:4084001 | Rps1k | N | 4084001 | [G/T] | Kingwa |
| Gm03:4084095 | Rps1k | N | 4084095 | [A/G] | Kingwa |
| Gm03:4085042 | Rps1k | N | 4085042 | [T/A] | Kingwa |
| Gm03:4085524 | Rps1k | N | 4085524 | [T/G] | Kingwa |
| Gm03:4086286 | Rps1k | N | 4086286 | [A/T] | Kingwa |
| Gm03:4086887 | Rps1k | N | 4086887 | [T/C] | Kingwa |
| Gm03:4087383 | Rps1k | N | 4087383 | [T/C] | Kingwa |
| Gm03:4088310 | Rps1k | N | 4088310 | [T/G] | Kingwa |
| Gm03:4090188 | Rps1k | N | 4090188 | [C/T] | Kingwa |
| Gm03:4092799 | Rps1k | N | 4092799 | [A/C] | Kingwa |
| Gm03:4092928 | Rps1k | N | 4092928 | [T/C] | Kingwa |
| Gm03:4093195 | Rps1k | N | 4093195 | [G/A] | Kingwa |
| Gm03:4093240 | Rps1k | N | 4093240 | [T/C] | Kingwa |
| Gm03:4097291 | Rps1k | N | 4097291 | [T/A] | Kingwa |
| Gm03:4097563 | Rps1k | N | 4097563 | [A/G] | Kingwa |
| Gm03:4097729 | Rps1k | N | 4097729 | [A/G] | Kingwa |
| Gm03:4098328 | Rps1k | N | 4098328 | [A/T] | Kingwa |
| Gm03:4100831 | Rps1k | N | 4100831 | [A/T] | Kingwa |
| Gm03:4101257 | Rps1k | N | 4101257 | [A/T] | Kingwa |
| Gm03:4103342 | Rps1k | N | 4103342 | [C/T] | Kingwa |
| Gm03:4103449 | Rps1k | N | 4103449 | [T/C] | Kingwa |
| Gm03:4103450 | Rps1k | N | 4103450 | [G/C] | Kingwa |
| Gm03:4103515 | Rps1k | N | 4103515 | [T/C] | Kingwa |
| Gm03:4103547 | Rps1k | N | 4103547 | [T/C] | Kingwa |
| Gm03:4103633 | Rps1k | N | 4103633 | [T/C] | Kingwa |
| Gm03:4104502 | Rps1k | N | 4104502 | [T/C] | Kingwa |
| Gm03:4106406 | Rps1k | N | 4106406 | [C/A] | Kingwa |
| Gm03:4109228 | Rps1k | N | 4109228 | [A/C] | Kingwa |
| Gm03:4110012 | Rps1k | N | 4110012 | [C/T] | Kingwa |
| Gm03:4110449 | Rps1k | N | 4110449 | [A/G] | Kingwa |
| Gm03:4110821 | Rps1k | N | 4110821 | [G/A] | Kingwa |
| Gm03:4111538 | Rps1k | N | 4111538 | [T/C] | Kingwa |
| Gm03:4113757 | Rps1k | N | 4113757 | [A/G] | Kingwa |
| Gm03:4116726 | Rps1k | N | 4116726 | [T/A] | Kingwa |
| Gm03:4117330 | Rps1k | N | 4117330 | [T/G] | Kingwa |
| Gm03:4117375 | Rps1k | N | 4117375 | [G/A] | Kingwa |
| Gm03:4117779 | Rps1k | N | 4117779 | [C/G] | Kingwa |
| Gm03:4117890 | Rps1k | N | 4117890 | [C/G] | Kingwa |
| Gm03:4117986 | Rps1k | N | 4117986 | [G/A] | Kingwa |
| Gm03:4120433 | Rps1k | N | 4120433 | [T/C] | Kingwa |
| Gm03:4120705 | Rps1k | N | 4120705 | [G/A] | Kingwa |
| Gm03:4122180 | Rps1k | N | 4122180 | [C/T] | Kingwa |
| Gm03:4129251 | Rps1k | N | 4129251 | [T/C] | Kingwa |
| Gm03:4129479 | Rps1k | N | 4129479 | [T/C] | Kingwa |
| Gm03:4129635 | Rps1k | N | 4129635 | [T/C] | Kingwa |
| Gm03:4130393 | Rps1k | N | 4130393 | [T/C] | Kingwa |
| Gm03:4131257 | Rps1k | N | 4131257 | [T/G] | Kingwa |
| Gm03:4132032 | Rps1k | N | 4132032 | [C/A] | Kingwa |
| Gm03:4132192 | Rps1k | N | 4132192 | [A/G] | Kingwa |
| Gm03:4133520 | Rps1k | N | 4133520 | [C/T] | Kingwa |
| Gm03:4134606 | Rps1k | N | 4134606 | [A/G] | Kingwa |
| Gm03:4134679 | Rps1k | N | 4134679 | [A/G] | Kingwa |
| Gm03:4136487 | Rps1k | N | 4136487 | [T/C] | Kingwa |
| Gm03:4136724 | Rps1k | N | 4136724 | [T/G] | Kingwa |
| Gm03:4136742 | Rps1k | N | 4136742 | [T/C] | Kingwa |
| Gm03:4136791 | Rps1k | N | 4136791 | [A/T] | Kingwa |
| Gm03:4136972 | Rps1k | N | 4136972 | [T/A] | Kingwa |
| Gm03:4137137 | Rps1k | N | 4137137 | [T/G] | Kingwa |
| Gm03:4137521 | Rps1k | N | 4137521 | [C/T] | Kingwa |
| Gm03:4137540 | Rps1k | N | 4137540 | [G/A] | Kingwa |
| Gm03:4137645 | Rps1k | N | 4137645 | [A/G] | Kingwa |
| Gm03:4138435 | Rps1k | N | 4138435 | [T/C] | Kingwa |
| Gm03:4138980 | Rps1k | N | 4138980 | [A/G] | Kingwa |
| Gm03:4139156 | Rps1k | N | 4139156 | [A/G] | Kingwa |
| Gm03:4139395 | Rps1k | N | 4139395 | [C/A] | Kingwa |
| Gm03:4140035 | Rps1k | N | 4140035 | [C/T] | Kingwa |
| Gm03:4140071 | Rps1k | N | 4140071 | [T/G] | Kingwa |
| Gm03:4140976 | Rps1k | N | 4140976 | [A/G] | Kingwa |
| Gm03:4141074 | Rps1k | N | 4141074 | [T/C] | Kingwa |
| Gm03:4141090 | Rps1k | N | 4141090 | [A/T] | Kingwa |
| Gm03:4141251 | Rps1k | N | 4141251 | [T/C] | Kingwa |
| Gm03:4141363 | Rps1k | N | 4141363 | [T/C] | Kingwa |
| Gm03:4141488 | Rps1k | N | 4141488 | [A/G] | Kingwa |
| Gm03:4142353 | Rps1k | N | 4142353 | [A/G] | Kingwa |
| Gm03:4142380 | Rps1k | N | 4142380 | [C/T] | Kingwa |
| Gm03:4142693 | Rps1k | N | 4142693 | [T/C] | Kingwa |
| Gm03:4142800 | Rps1k | N | 4142800 | [T/C] | Kingwa |
| Gm03:4142810 | Rps1k | N | 4142810 | [T/C] | Kingwa |

TABLE 1B-continued

| Marker ID | Locus | LG | Physical Position | Allele [R/S] | Source |
|---|---|---|---|---|---|
| Gm03:4143060 | Rps1k | N | 4143060 | [A/C] | Kingwa |
| Gm03:4143112 | Rps1k | N | 4143112 | [A/T] | Kingwa |
| Gm03:4143113 | Rps1k | N | 4143113 | [T/G] | Kingwa |
| Gm03:4144137 | Rps1k | N | 4144137 | [T/C] | Kingwa |
| Gm03:4144350 | Rps1k | N | 4144350 | [T/C] | Kingwa |
| Gm03:4144639 | Rps1k | N | 4144639 | [T/C] | Kingwa |
| Gm03:4145737 | Rps1k | N | 4145737 | [A/G] | Kingwa |
| Gm03:4145959 | Rps1k | N | 4145959 | [C/G] | Kingwa |
| Gm03:4145974 | Rps1k | N | 4145974 | [G/C] | Kingwa |
| Gm03:4146284 | Rps1k | N | 4146284 | [A/G] | Kingwa |
| Gm03:4147289 | Rps1k | N | 4147289 | [C/G] | Kingwa |
| Gm03:4147425 | Rps1k | N | 4147425 | [C/T] | Kingwa |
| Gm03:4148248 | Rps1k | N | 4148248 | [A/G] | Kingwa |
| Gm03:4148643 | Rps1k | N | 4148643 | [C/T] | Kingwa |
| Gm03:4148732 | Rps1k | N | 4148732 | [A/G] | Kingwa |
| Gm03:4149880 | Rps1k | N | 4149880 | [A/G] | Kingwa |
| Gm03:4149919 | Rps1k | N | 4149919 | [A/G] | Kingwa |
| Gm03:4150189 | Rps1k | N | 4150189 | [C/T] | Kingwa |
| Gm03:4150330 | Rps1k | N | 4150330 | [T/C] | Kingwa |
| Gm03:4151366 | Rps1k | N | 4151366 | [A/G] | Kingwa |
| Gm03:4152106 | Rps1k | N | 4152106 | [T/C] | Kingwa |
| Gm03:4153221 | Rps1k | N | 4153221 | [A/T] | Kingwa |
| Gm03:4153413 | Rps1k | N | 4153413 | [A/T] | Kingwa |
| Gm03:4153505 | Rps1k | N | 4153505 | [C/T] | Kingwa |
| Gm03:4153885 | Rps1k | N | 4153885 | [C/T] | Kingwa |
| Gm03:4154059 | Rps1k | N | 4154059 | [A/C] | Kingwa |
| Gm03:4156891 | Rps1k | N | 4156891 | [A/G] | Kingwa |
| Gm03:4158622 | Rps1k | N | 4158622 | [G/T] | Kingwa |
| Gm03:4159661 | Rps1k | N | 4159661 | [C/G] | Kingwa |
| Gm03:4160698 | Rps1k | N | 4160698 | [C/T] | Kingwa |
| Gm03:4162268 | Rps1k | N | 4162268 | [A/G] | Kingwa |
| Gm03:4163423 | Rps1k | N | 4163423 | [G/A] | Kingwa |
| Gm03:4164061 | Rps1k | N | 4164061 | [T/C] | Kingwa |
| Gm03:4164065 | Rps1k | N | 4164065 | [T/C] | Kingwa |
| Gm03:4164142 | Rps1k | N | 4164142 | [A/G] | Kingwa |
| Gm03:4164401 | Rps1k | N | 4164401 | [A/G] | Kingwa |
| Gm03:4164507 | Rps1k | N | 4164507 | [T/C] | Kingwa |
| Gm03:4164719 | Rps1k | N | 4164719 | [A/G] | Kingwa |
| Gm03:4164807 | Rps1k | N | 4164807 | [A/G] | Kingwa |
| Gm03:4166307 | Rps1k | N | 4166307 | [C/A] | Kingwa |
| Gm03:4166432 | Rps1k | N | 4166432 | [G/A] | Kingwa |
| Gm03:4167439 | Rps1k | N | 4167439 | [C/T] | Kingwa |
| Gm03:4167591 | Rps1k | N | 4167591 | [C/T] | Kingwa |
| Gm03:4167701 | Rps1k | N | 4167701 | [A/G] | Kingwa |
| Gm03:4168907 | Rps1k | N | 4168907 | [T/A] | Kingwa |
| Gm03:4169729 | Rps1k | N | 4169729 | [A/G] | Kingwa |
| Gm03:4169784 | Rps1k | N | 4169784 | [A/G] | Kingwa |
| Gm03:4169863 | Rps1k | N | 4169863 | [G/A] | Kingwa |
| Gm03:4169950 | Rps1k | N | 4169950 | [T/C] | Kingwa |
| Gm03:4169995 | Rps1k | N | 4169995 | [G/C] | Kingwa |
| Gm03:4171393 | Rps1k | N | 4171393 | [C/T] | Kingwa |
| Gm03:4171766 | Rps1k | N | 4171766 | [A/T] | Kingwa |
| Gm03:4172171 | Rps1k | N | 4172171 | [A/C] | Kingwa |
| Gm03:4173195 | Rps1k | N | 4173195 | [A/G] | Kingwa |
| Gm03:4173316 | Rps1k | N | 4173316 | [C/T] | Kingwa |
| Gm03:4173405 | Rps1k | N | 4173405 | [T/C] | Kingwa |
| Gm03:4173524 | Rps1k | N | 4173524 | [A/C] | Kingwa |
| Gm03:4175127 | Rps1k | N | 4175127 | [A/G] | Kingwa |
| Gm03:4177056 | Rps1k | N | 4177056 | [A/T] | Kingwa |
| Gm03:4177689 | Rps1k | N | 4177689 | [A/G] | Kingwa |
| Gm03:4177690 | Rps1k | N | 4177690 | [G/A] | Kingwa |
| Gm03:4178958 | Rps1k | N | 4178958 | [A/G] | Kingwa |
| Gm03:4179972 | Rps1k | N | 4179972 | [T/C] | Kingwa |
| Gm03:4180458 | Rps1k | N | 4180458 | [A/G] | Kingwa |
| Gm03:4182337 | Rps1k | N | 4182337 | [G/A] | Kingwa |
| Gm03:4184380 | Rps1k | N | 4184380 | [T/G] | Kingwa |
| Gm03:4184951 | Rps1k | N | 4184951 | [T/G] | Kingwa |
| Gm03:4184971 | Rps1k | N | 4184971 | [T/A] | Kingwa |
| Gm03:4185234 | Rps1k | N | 4185234 | [A/G] | Kingwa |
| Gm03:4185400 | Rps1k | N | 4185400 | [G/A] | Kingwa |
| Gm03:4185863 | Rps1k | N | 4185863 | [T/C] | Kingwa |
| Gm03:4187256 | Rps1k | N | 4187256 | [A/G] | Kingwa |
| Gm03:4188732 | Rps1k | N | 4188732 | [T/C] | Kingwa |
| Gm03:4189845 | Rps1k | N | 4189845 | [C/T] | Kingwa |
| Gm03:4189964 | Rps1k | N | 4189964 | [T/C] | Kingwa |
| Gm03:4190679 | Rps1k | N | 4190679 | [G/C] | Kingwa |
| Gm03:4191313 | Rps1k | N | 4191313 | [A/G] | Kingwa |
| Gm03:4191519 | Rps1k | N | 4191519 | [T/C] | Kingwa |
| Gm03:4192359 | Rps1k | N | 4192359 | [T/C] | Kingwa |
| Gm03:4192478 | Rps1k | N | 4192478 | [A/G] | Kingwa |
| Gm03:4192513 | Rps1k | N | 4192513 | [T/C] | Kingwa |
| Gm03:4192621 | Rps1k | N | 4192621 | [C/T] | Kingwa |
| Gm03:4192738 | Rps1k | N | 4192738 | [G/A] | Kingwa |
| Gm03:4193009 | Rps1k | N | 4193009 | [T/C] | Kingwa |
| Gm03:4193030 | Rps1k | N | 4193030 | [G/T] | Kingwa |
| Gm03:4193039 | Rps1k | N | 4193039 | [G/T] | Kingwa |
| Gm03:4193483 | Rps1k | N | 4193483 | [T/C] | Kingwa |
| Gm03:4196188 | Rps1k | N | 4196188 | [T/C] | Kingwa |
| Gm03:4196542 | Rps1k | N | 4196542 | [T/C] | Kingwa |
| Gm03:4197697 | Rps1k | N | 4197697 | [T/A] | Kingwa |
| Gm03:4197774 | Rps1k | N | 4197774 | [A/T] | Kingwa |
| Gm03:4198285 | Rps1k | N | 4198285 | [A/G] | Kingwa |
| Gm03:4198508 | Rps1k | N | 4198508 | [C/A] | Kingwa |
| Gm03:4198711 | Rps1k | N | 4198711 | [A/C] | Kingwa |
| Gm03:4198914 | Rps1k | N | 4198914 | [A/G] | Kingwa |
| Gm03:4199748 | Rps1k | N | 4199748 | [G/A] | Kingwa |
| Gm03:4200094 | Rps1k | N | 4200094 | [A/C] | Kingwa |
| Gm03:4203253 | Rps1k | N | 4203253 | [G/C] | Kingwa |
| Gm03:4203462 | Rps1k | N | 4203462 | [G/A] | Kingwa |
| Gm03:4203594 | Rps1k | N | 4203594 | [C/T] | Kingwa |
| Gm03:4203626 | Rps1k | N | 4203626 | [C/G] | Kingwa |
| Gm03:4204747 | Rps1k | N | 4204747 | [A/G] | Kingwa |
| Gm03:4204867 | Rps1k | N | 4204867 | [A/G] | Kingwa |
| Gm03:4205828 | Rps1k | N | 4205828 | [C/G] | Kingwa |
| Gm03:4205953 | Rps1k | N | 4205953 | [T/C] | Kingwa |
| Gm03:4206870 | Rps1k | N | 4206870 | [G/A] | Kingwa |
| Gm03:4207703 | Rps1k | N | 4207703 | [G/A] | Kingwa |
| Gm03:4215115 | Rps1k | N | 4215115 | [C/T] | Kingwa |
| Gm03:4215690 | Rps1k | N | 4215690 | [T/G] | Kingwa |
| Gm03:4215950 | Rps1k | N | 4215950 | [A/G] | Kingwa |
| Gm03:4217736 | Rps1k | N | 4217736 | [G/T] | Kingwa |
| Gm03:4218032 | Rps1k | N | 4218032 | [C/A] | Kingwa |
| Gm03:4218527 | Rps1k | N | 4218527 | [C/A] | Kingwa |
| Gm03:4218716 | Rps1k | N | 4218716 | [G/A] | Kingwa |
| Gm03:4218990 | Rps1k | N | 4218990 | [G/T] | Kingwa |
| Gm03:4219539 | Rps1k | N | 4219539 | [A/T] | Kingwa |
| Gm03:4219667 | Rps1k | N | 4219667 | [A/G] | Kingwa |
| Gm03:4221288 | Rps1k | N | 4221288 | [T/C] | Kingwa |
| Gm03:4222312 | Rps1k | N | 4222312 | [A/C] | Kingwa |
| Gm03:4223122 | Rps1k | N | 4223122 | [A/G] | Kingwa |
| Gm03:4223821 | Rps1k | N | 4223821 | [T/C] | Kingwa |
| Gm03:4224501 | Rps1k | N | 4224501 | [T/C] | Kingwa |
| Gm03:4225137 | Rps1k | N | 4225137 | [G/A] | Kingwa |
| Gm03:4225960 | Rps1k | N | 4225960 | [A/C] | Kingwa |
| Gm03:4226471 | Rps1k | N | 4226471 | [T/A] | Kingwa |
| Gm03:4227488 | Rps1k | N | 4227488 | [C/G] | Kingwa |
| Gm03:4228931 | Rps1k | N | 4228931 | [A/G] | Kingwa |
| Gm03:4229006 | Rps1k | N | 4229006 | [C/T] | Kingwa |
| Gm03:4229247 | Rps1k | N | 4229247 | [A/C] | Kingwa |
| Gm03:4230412 | Rps1k | N | 4230412 | [A/G] | Kingwa |
| Gm03:4230665 | Rps1k | N | 4230665 | [A/G] | Kingwa |
| Gm03:4230768 | Rps1k | N | 4230768 | [C/T] | Kingwa |
| Gm03:4231904 | Rps1k | N | 4231904 | [G/A] | Kingwa |
| Gm03:4231979 | Rps1k | N | 4231979 | [G/A] | Kingwa |
| Gm03:4233068 | Rps1k | N | 4233068 | [T/C] | Kingwa |
| Gm03:4233431 | Rps1k | N | 4233431 | [G/C] | Kingwa |
| Gm03:4233493 | Rps1k | N | 4233493 | [G/C] | Kingwa |
| Gm03:4233550 | Rps1k | N | 4233550 | [T/C] | Kingwa |
| Gm03:4234109 | Rps1k | N | 4234109 | [C/T] | Kingwa |
| Gm03:4234194 | Rps1k | N | 4234194 | [A/G] | Kingwa |
| Gm03:4234277 | Rps1k | N | 4234277 | [A/G] | Kingwa |
| Gm03:4234310 | Rps1k | N | 4234310 | [T/A] | Kingwa |
| Gm03:4235089 | Rps1k | N | 4235089 | [G/A] | Kingwa |
| Gm03:4235183 | Rps1k | N | 4235183 | [T/C] | Kingwa |
| Gm03:4235519 | Rps1k | N | 4235519 | [T/C] | Kingwa |
| Gm03:4235634 | Rps1k | N | 4235634 | [A/C] | Kingwa |
| Gm03:4235844 | Rps1k | N | 4235844 | [G/A] | Kingwa |
| Gm03:4236123 | Rps1k | N | 4236123 | [T/C] | Kingwa |
| Gm03:4236298 | Rps1k | N | 4236298 | [C/T] | Kingwa |
| Gm03:4239026 | Rps1k | N | 4239026 | [T/C] | Kingwa |
| Gm03:4242434 | Rps1k | N | 4242434 | [G/T] | Kingwa |
| Gm03:4243529 | Rps1k | N | 4243529 | [C/T] | Kingwa |
| Gm03:4244201 | Rps1k | N | 4244201 | [T/C] | Kingwa |
| Gm03:4244338 | Rps1k | N | 4244338 | [A/C] | Kingwa |

TABLE 1B-continued

| Marker ID | Locus | LG | Physical Position | Allele [R/S] | Source |
|---|---|---|---|---|---|
| Gm03:4244497 | Rps1k | N | 4244497 | [T/G] | Kingwa |
| Gm03:4245348 | Rps1k | N | 4245348 | [G/A] | Kingwa |
| Gm03:4245390 | Rps1k | N | 4245390 | [T/C] | Kingwa |
| Gm03:4245678 | Rps1k | N | 4245678 | [A/G] | Kingwa |
| Gm03:4246770 | Rps1k | N | 4246770 | [A/G] | Kingwa |
| Gm03:4246837 | Rps1k | N | 4246837 | [T/G] | Kingwa |
| Gm03:4247592 | Rps1k | N | 4247592 | [A/G] | Kingwa |
| Gm03:4247726 | Rps1k | N | 4247726 | [C/T] | Kingwa |
| Gm03:4252413 | Rps1k | N | 4252413 | [A/T] | Kingwa |
| Gm03:4252569 | Rps1k | N | 4252569 | [G/A] | Kingwa |
| Gm03:4252894 | Rps1k | N | 4252894 | [G/A] | Kingwa |
| Gm03:4252928 | Rps1k | N | 4252928 | [G/A] | Kingwa |
| Gm03:4253518 | Rps1k | N | 4253518 | [T/C] | Kingwa |
| Gm03:4257596 | Rps1k | N | 4257596 | [A/C] | Kingwa |
| Gm03:4257995 | Rps1k | N | 4257995 | [G/C] | Kingwa |
| Gm03:4258161 | Rps1k | N | 4258161 | [T/G] | Kingwa |
| Gm03:4258545 | Rps1k | N | 4258545 | [T/C] | Kingwa |
| Gm03:4260785 | Rps1k | N | 4260785 | [A/G] | Kingwa |
| Gm03:4260901 | Rps1k | N | 4260901 | [C/T] | Kingwa |
| Gm03:4261372 | Rps1k | N | 4261372 | [T/A] | Kingwa |
| Gm03:4261626 | Rps1k | N | 4261626 | [A/T] | Kingwa |
| Gm03:4262516 | Rps1k | N | 4262516 | [C/G] | Kingwa |
| Gm03:4262869 | Rps1k | N | 4262869 | [G/A] | Kingwa |
| Gm03:4263876 | Rps1k | N | 4263876 | [A/G] | Kingwa |
| Gm03:4264709 | Rps1k | N | 4264709 | [C/T] | Kingwa |
| Gm03:4265916 | Rps1k | N | 4265916 | [A/G] | Kingwa |
| Gm03:4266927 | Rps1k | N | 4266927 | [A/G] | Kingwa |
| Gm03:4267296 | Rps1k | N | 4267296 | [A/G] | Kingwa |
| Gm03:4268640 | Rps1k | N | 4268640 | [C/G] | Kingwa |
| Gm03:4268852 | Rps1k | N | 4268852 | [G/A] | Kingwa |
| Gm03:4295832 | Rps1k | N | 4295832 | [A/G] | Kingwa |
| Gm03:4302907 | Rps1k | N | 4302907 | [G/C] | Kingwa |
| Gm03:4302936 | Rps1k | N | 4302936 | [A/T] | Kingwa |
| Gm03:4306709 | Rps1k | N | 4306709 | [T/C] | Kingwa |
| Gm03:4307835 | Rps1k | N | 4307835 | [C/A] | Kingwa |
| Gm03:4307996 | Rps1k | N | 4307996 | [G/A] | Kingwa |
| Gm03:4308161 | Rps1k | N | 4308161 | [T/A] | Kingwa |
| Gm03:4308286 | Rps1k | N | 4308286 | [C/T] | Kingwa |
| Gm03:4308323 | Rps1k | N | 4308323 | [G/T] | Kingwa |
| Gm03:4308522 | Rps1k | N | 4308522 | [T/A] | Kingwa |
| Gm03:4313900 | Rps1k | N | 4313900 | [C/T] | Kingwa |
| Gm03:4314212 | Rps1k | N | 4314212 | [G/T] | Kingwa |
| Gm03:4314464 | Rps1k | N | 4314464 | [G/C] | Kingwa |
| Gm03:4315256 | Rps1k | N | 4315256 | [A/G] | Kingwa |
| Gm03:4317574 | Rps1k | N | 4317574 | [G/C] | Kingwa |
| Gm03:4318530 | Rps1k | N | 4318530 | [A/G] | Kingwa |
| Gm03:4319271 | Rps1k | N | 4319271 | [C/G] | Kingwa |
| Gm03:4320841 | Rps1k | N | 4320841 | [A/G] | Kingwa |
| Gm03:4321243 | Rps1k | N | 4321243 | [C/T] | Kingwa |
| Gm03:4321515 | Rps1k | N | 4321515 | [T/G] | Kingwa |
| Gm03:4328502 | Rps1k | N | 4328502 | [G/T] | Kingwa |
| Gm03:4329219 | Rps1k | N | 4329219 | [C/G] | Kingwa |
| Gm03:4329504 | Rps1k | N | 4329504 | [T/C] | Kingwa |
| Gm03:4330121 | Rps1k | N | 4330121 | [A/G] | Kingwa |
| Gm03:4330318 | Rps1k | N | 4330318 | [T/C] | Kingwa |
| Gm03:4331246 | Rps1k | N | 4331246 | [A/G] | Kingwa |
| Gm03:4331889 | Rps1k | N | 4331889 | [A/G] | Kingwa |
| Gm03:4337173 | Rps1k | N | 4337173 | [G/A] | Kingwa |
| Gm03:4338377 | Rps1k | N | 4338377 | [G/C] | Kingwa |
| Gm03:4338505 | Rps1k | N | 4338505 | [A/G] | Kingwa |
| Gm03:4338559 | Rps1k | N | 4338559 | [T/A] | Kingwa |
| Gm03:4339885 | Rps1k | N | 4339885 | [T/A] | Kingwa |
| Gm03:4341064 | Rps1k | N | 4341064 | [A/G] | Kingwa |
| Gm03:4342692 | Rps1k | N | 4342692 | [T/C] | Kingwa |
| Gm03:4342727 | Rps1k | N | 4342727 | [A/T] | Kingwa |
| Gm03:4343201 | Rps1k | N | 4343201 | [A/G] | Kingwa |
| Gm03:4343212 | Rps1k | N | 4343212 | [T/C] | Kingwa |
| Gm03:4348211 | Rps1k | N | 4348211 | [T/C] | Kingwa |
| Gm03:4350556 | Rps1k | N | 4350556 | [A/T] | Kingwa |
| Gm03:4350658 | Rps1k | N | 4350658 | [A/G] | Kingwa |
| Gm03:4350767 | Rps1k | N | 4350767 | [G/A] | Kingwa |
| Gm03:4351326 | Rps1k | N | 4351326 | [T/G] | Kingwa |
| Gm03:4351612 | Rps1k | N | 4351612 | [T/G] | Kingwa |
| Gm03:4351617 | Rps1k | N | 4351617 | [T/G] | Kingwa |
| Gm03:4351674 | Rps1k | N | 4351674 | [A/C] | Kingwa |
| Gm03:4352353 | Rps1k | N | 4352353 | [T/G] | Kingwa |
| Gm03:4353932 | Rps1k | N | 4353932 | [T/C] | Kingwa |
| Gm03:4354036 | Rps1k | N | 4354036 | [C/G] | Kingwa |
| Gm03:4355046 | Rps1k | N | 4355046 | [C/G] | Kingwa |
| Gm03:4362911 | Rps1k | N | 4362911 | [A/G] | Kingwa |
| Gm03:4363385 | Rps1k | N | 4363385 | [A/T] | Kingwa |
| Gm03:4363855 | Rps1k | N | 4363855 | [T/C] | Kingwa |
| Gm03:4364133 | Rps1k | N | 4364133 | [A/G] | Kingwa |
| Gm03:4364176 | Rps1k | N | 4364176 | [G/T] | Kingwa |
| Gm03:4364200 | Rps1k | N | 4364200 | [A/C] | Kingwa |
| Gm03:4364469 | Rps1k | N | 4364469 | [A/G] | Kingwa |
| Gm03:4385480 | Rps1k | N | 4385480 | [G/A] | Kingwa |
| Gm03:4385781 | Rps1k | N | 4385781 | [A/G] | Kingwa |
| Gm03:4386327 | Rps1k | N | 4386327 | [A/G] | Kingwa |
| Gm03:4386398 | Rps1k | N | 4386398 | [G/C] | Kingwa |
| Gm03:4386633 | Rps1k | N | 4386633 | [G/A] | Kingwa |
| Gm03:4386927 | Rps1k | N | 4386927 | [C/T] | Kingwa |
| Gm03:4387264 | Rps1k | N | 4387264 | [T/C] | Kingwa |
| Gm03:4388736 | Rps1k | N | 4388736 | [A/T] | Kingwa |
| Gm03:4388954 | Rps1k | N | 4388954 | [T/C] | Kingwa |
| Gm03:4388982 | Rps1k | N | 4388982 | [A/G] | Kingwa |
| Gm03:4389208 | Rps1k | N | 4389208 | [T/C] | Kingwa |
| Gm03:4389211 | Rps1k | N | 4389211 | [A/G] | Kingwa |
| Gm03:4389280 | Rps1k | N | 4389280 | [A/C] | Kingwa |
| Gm03:4389696 | Rps1k | N | 4389696 | [T/A] | Kingwa |
| Gm03:4390074 | Rps1k | N | 4390074 | [G/A] | Kingwa |
| Gm03:4390738 | Rps1k | N | 4390738 | [A/T] | Kingwa |
| Gm03:4390827 | Rps1k | N | 4390827 | [C/T] | Kingwa |
| Gm03:4390979 | Rps1k | N | 4390979 | [C/A] | Kingwa |
| Gm03:4392217 | Rps1k | N | 4392217 | [A/T] | Kingwa |
| Gm03:4392314 | Rps1k | N | 4392314 | [C/G] | Kingwa |
| Gm03:4392891 | Rps1k | N | 4392891 | [G/A] | Kingwa |
| Gm03:4392913 | Rps1k | N | 4392913 | [G/T] | Kingwa |
| Gm03:4394477 | Rps1k | N | 4394477 | [C/G] | Kingwa |
| Gm03:4394831 | Rps1k | N | 4394831 | [A/G] | Kingwa |
| Gm03:4395386 | Rps1k | N | 4395386 | [T/C] | Kingwa |
| Gm03:4395962 | Rps1k | N | 4395962 | [A/C] | Kingwa |
| Gm03:4397872 | Rps1k | N | 4397872 | [A/G] | Kingwa |
| Gm03:4398299 | Rps1k | N | 4398299 | [A/T] | Kingwa |
| Gm03:4398919 | Rps1k | N | 4398919 | [T/C] | Kingwa |
| Gm03:4399399 | Rps1k | N | 4399399 | [G/A] | Kingwa |
| Gm03:4400461 | Rps1k | N | 4400461 | [C/G] | Kingwa |
| Gm03:4404444 | Rps1k | N | 4404444 | [C/T] | Kingwa |
| Gm03:4410393 | Rps1k | N | 4410393 | [A/G] | Kingwa |
| Gm03:4410565 | Rps1k | N | 4410565 | [T/C] | Kingwa |
| Gm03:4411187 | Rps1k | N | 4411187 | [T/C] | Kingwa |
| Gm03:4412149 | Rps1k | N | 4412149 | [A/T] | Kingwa |
| Gm03:4412417 | Rps1k | N | 4412417 | [A/G] | Kingwa |
| Gm03:4412774 | Rps1k | N | 4412774 | [T/C] | Kingwa |
| Gm03:4413415 | Rps1k | N | 4413415 | [C/T] | Kingwa |
| Gm03:4446891 | Rps1k | N | 4446891 | [T/C] | Kingwa |
| Gm03:4447988 | Rps1k | N | 4447988 | [A/C] | Kingwa |
| Gm03:4448825 | Rps1k | N | 4448825 | [C/A] | Kingwa |
| Gm03:4449634 | Rps1k | N | 4449634 | [T/A] | Kingwa |
| Gm03:4449956 | Rps1k | N | 4449956 | [T/G] | Kingwa |
| Gm03:4450328 | Rps1k | N | 4450328 | [C/T] | Kingwa |
| Gm03:4450331 | Rps1k | N | 4450331 | [G/A] | Kingwa |
| Gm03:4450888 | Rps1k | N | 4450888 | [T/A] | Kingwa |
| Gm03:4451295 | Rps1k | N | 4451295 | [A/T] | Kingwa |
| Gm03:4451491 | Rps1k | N | 4451491 | [A/C] | Kingwa |
| Gm03:4451503 | Rps1k | N | 4451503 | [T/G] | Kingwa |
| Gm03:4451847 | Rps1k | N | 4451847 | [T/A] | Kingwa |
| Gm03:4452060 | Rps1k | N | 4452060 | [A/G] | Kingwa |
| Gm03:4452118 | Rps1k | N | 4452118 | [A/G] | Kingwa |
| Gm03:4452820 | Rps1k | N | 4452820 | [T/A] | Kingwa |
| Gm03:4456305 | Rps1k | N | 4456305 | [T/C] | Kingwa |
| Gm03:4458273 | Rps1k | N | 4458273 | [G/A] | Kingwa |
| Gm03:4458399 | Rps1k | N | 4458399 | [A/T] | Kingwa |
| Gm03:4461465 | Rps1k | N | 4461465 | [T/A] | Kingwa |
| Gm03:4462225 | Rps1k | N | 4462225 | [A/C] | Kingwa |
| Gm03:4471412 | Rps1k | N | 4471412 | [T/C] | Kingwa |
| Gm03:4474352 | Rps1k | N | 4474352 | [A/G] | Kingwa |
| Gm03:4477946 | Rps1k | N | 4477946 | [A/G] | Kingwa |
| Gm03:4477947 | Rps1k | N | 4477947 | [C/G] | Kingwa |
| Gm03:4478247 | Rps1k | N | 4478247 | [C/T] | Kingwa |
| Gm03:4478479 | Rps1k | N | 4478479 | [G/C] | Kingwa |
| Gm03:4478554 | Rps1k | N | 4478554 | [A/T] | Kingwa |
| Gm03:4478921 | Rps1k | N | 4478921 | [A/G] | Kingwa |
| Gm03:4479127 | Rps1k | N | 4479127 | [T/A] | Kingwa |

TABLE 1B-continued

| Marker ID | Locus | LG | Physical Position | Allele [R/S] | Source |
|---|---|---|---|---|---|
| Gm03:4506056 | Rps1k | N | 4506056 | [A/G] | Kingwa |
| Gm03:4506139 | Rps1k | N | 4506139 | [A/G] | Kingwa |
| Gm03:4506147 | Rps1k | N | 4506147 | [T/C] | Kingwa |
| Gm03:4507198 | Rps1k | N | 4507198 | [A/T] | Kingwa |
| Gm03:4525141 | Rps1k | N | 4525141 | [A/G] | Kingwa |
| Gm03:4525736 | Rps1k | N | 4525736 | [C/T] | Kingwa |
| Gm03:4526278 | Rps1k | N | 4526278 | [C/T] | Kingwa |
| Gm03:4526393 | Rps1k | N | 4526393 | [C/T] | Kingwa |
| Gm03:4526446 | Rps1k | N | 4526446 | [G/C] | Kingwa |
| Gm03:4527054 | Rps1k | N | 4527054 | [A/T] | Kingwa |
| Gm03:4533559 | Rps1k | N | 4533559 | [A/T] | Kingwa |
| Gm03:4539866 | Rps1k | N | 4539866 | [A/G] | Kingwa |
| Gm03:4541294 | Rps1k | N | 4541294 | [A/G] | Kingwa |

*Gm composite 2003 Genetic Map
** Physical positions are based on Public JGI Glyma1 Williams82 reference.

In certain embodiments, multiple marker loci that collectively make up a *Phytophthora* tolerance haplotype of interest are investigated. For example, 2, 3, 4, 5, 6, 7, 8, 9, 10, or more of the various marker loci provided herein can comprise a *Phytophthora* tolerance haplotype. In some embodiments, the haplotype comprises: (a) two or more marker loci associated with the Rps1a, Rps1c, Rps1d or Rps1k loci found on linkage group N; (b) two or more marker loci comprising S08291-1, S07292-1, 508242-1, S16592-001, S07963-2, S07372-1, S00009-01, S08013-1, any of the Rps1k marker loci in Table 1B, or a closely linked marker on linkage group N; (c) two or more marker loci associated with the Rps2 locus found on linkage group J; (d) two or more marker loci comprising S06862-1, S06863-1, S06864-1, S06865-1, S11652-1, S11682-1 or a marker closely linked thereto on linkage group J; (e) two or more marker loci associated with the Rps3a or Rps3c loci found on linkage group F; (f) two or more marker loci comprising S09018-1, S08342-1, S07163-1 or a marker closely linked thereto on linkage group F; (g) two or more marker loci associated with the Rps6 locus found on linkage group G; or (h) two or more marker loci comprising S08442-1, S08341-1 or a marker closely linked thereto on linkage group G.

In one embodiment, the method of identifying a first soybean plant or a first soybean germplasm that displays tolerance or improved tolerance to *Phytophthora* infection comprises detecting in the genome of the first soybean plant or in the genome of the first soybean germplasm at least one haplotype that is associated with the tolerance, wherein the at least one haplotype comprises at least two of the various marker loci provided herein.

In certain embodiments, two or more marker loci or haplotypes can collectively make up a marker profile. The marker profile can comprise any two or more marker loci comprising: (a) any marker loci associated with the Rps1a, Rps1c, Rps1d or Rps1k loci found on linkage group N; (b) marker loci comprising S08291-1, S07292-1, S08242-1, S16592-001, S07963-2, S07372-1, S00009-01, S08013-1, any of the Rps1k marker loci in Table 1B, or a closely linked marker on linkage group N; (c) any marker loci associated with the Rps2 locus found on linkage group J; (d) marker loci comprising S06862-1, S06863-1, S06864-1, S06865-1, S11652-1, S11682-1 or a marker closely linked thereto on linkage group J; (e) any marker loci associated with the Rps3a or Rps3c loci found on linkage group F; (f) marker loci comprising S09018-1, S08342-1, S07163-1 or a marker closely linked thereto on linkage group F; (g) any marker loci associated with the Rps6 locus found on linkage group G; and/or (h) marker loci comprising S08442-1, S08341-1 or a marker closely linked thereto on linkage group G.

Any marker loci associated with *Phytophthora* tolerance can be combined in the marker profile with any of the marker loci disclosed herein. For example, the marker profile can comprise 2, 3, 4, 5, 6, 7, 8, 9, 10, 11, 12, 13, 14, 15, 16, 17, 18, 19, 20, or more marker loci or haplotypes associated with tolerance to *Phytophthora* infection provided herein (i.e. the various marker loci provided in Tables 1A and 1B and in FIGS. 1-4).

In one embodiment, a method of identifying a first soybean plant or a first soybean germplasm that displays tolerance or improved tolerance to *Phytophthora* infection comprises detecting in the genome of the first soybean plant or in the genome of the first soybean germplasm at least one marker profile that is associated with the tolerance, wherein the at least one marker profile comprises at least two of the various marker loci provided herein. In some embodiments, the marker profile comprises any combination of two or more marker loci from any of the various Rps loci, for example, Rps1, Rps2, Rps3, Rps4, Rps5, Rps6, Rps7 or Rps8.

Not only can one detect the various markers provided herein, it is recognized that one could detect any markers that are closely linked to the various markers discussed herein. Non-limiting examples of markers closely linked the various markers discussed herein are provided in Tables 1A and 1B and in FIGS. 1-4.

In addition to the markers discussed herein, information regarding useful soybean markers can be found, for example, on the USDA's Soybase website, available at www.soybase.org. One of skill in the art will recognize that the identification of favorable marker alleles may be germplasm-specific. The determination of which marker alleles correlate with tolerance (or susceptibility) is determined for the particular germplasm under study. One of skill will also recognize that methods for identifying the favorable alleles are routine and well known in the art, and furthermore, that the identification and use of such favorable alleles is well within the scope of the invention.

Various methods are provided to identify soybean plants and/or germplasm with tolerance or improved tolerance to *Phytophthora* infection. In one embodiment, the method of identifying comprises detecting at least one marker locus associated with tolerance to *Phytophthora*. The term "associated with" in connection with a relationship between a marker locus and a phenotype refers to a statistically significant dependence of marker frequency with respect to a quantitative scale or qualitative gradation of the phenotype. Thus, an allele of a marker is associated with a trait of interest when the allele of the marker locus and the trait phenotypes are found together in the progeny of an organism more often than if the marker genotypes and trait phenotypes segregated separately.

Any combination of the marker loci provided herein can be used in the methods to identify a soybean plant or soybean germplasm that displays tolerance or improved tolerance to *Phytophthora* infection. Any one marker locus or any combination of the markers set forth in Table 1, or any closely linked marker can be used to aid in identifying and selecting soybean plants or soybean germplasm with tolerance or improved tolerance to *Phytophthora* infection.

In one embodiment, a method of identifying a first soybean plant or a first soybean germplasm that displays tolerance or improved tolerance to *Phytophthora* infection is provided. The method comprises detecting in the genome of the first soybean plant or first soybean germplasm at least one marker locus that is associated with tolerance. In such a method, the at least one marker locus: (a) can be associated with the Rps1a, Rps1c, Rps1d or Rps1k loci found on linkage group N; (b) can comprise one or more of the marker loci S08291-1, S07292-1, S08242-1, S16592-001, S07963-2, S07372-1, S00009-01, S08013-1, any of the Rps1k marker loci in Table 1B, or a closely linked marker on linkage group N; (c) can be associated with the Rps2 locus found on linkage group J; (d) can comprise one or more of the marker loci S06862-1, S06863-1, S06864-1, S06865-1, S11652-1, S11682-1 or a marker closely linked thereto on linkage group J; (e) can be associated with the Rps3a or Rps3c loci found on linkage group F; (f) can comprise one or more of the marker loci S09018-1, S08342-1, S07163-1 or a marker closely linked thereto on linkage group F; (g) can be associated with the Rps6 locus found on linkage group G; and/or (h) can comprise one or more of the marker loci S08442-1, S08341-1 or a marker closely linked thereto on linkage group G.

In other embodiments, two or more marker loci are detected in the method. In a specific embodiment, the germplasm is a soybean variety.

In other embodiments, the method further comprises crossing the selected first soybean plant or first soybean germplasm with a second soybean plant or second soybean germplasm. In a further embodiment of the method, the second soybean plant or second soybean germplasm comprises an exotic soybean strain or an elite soybean strain.

In specific embodiments, the first soybean plant or first soybean germplasm comprises a soybean variety. Any soybean line known to the art or disclosed herein may be used. Non-limiting examples of soybean varieties and their associated *Phytophthora* tolerance alleles encompassed by the methods provided herein include, for example, those listed in Table 1.

In another embodiment, the detection method comprises amplifying at least one marker locus and detecting the resulting amplified marker amplicon. In such a method, amplifying comprises (a) admixing an amplification primer or amplification primer pair for each marker locus being amplified with a nucleic acid isolated from the first soybean plant or the first soybean germplasm such that the primer or primer pair is complementary or partially complementary to a variant or fragment of the genomic locus comprising the marker locus and is capable of initiating DNA polymerization by a DNA polymerase using the soybean nucleic acid as a template; and (b) extending the primer or primer pair in a DNA polymerization reaction comprising a DNA polymerase and a template nucleic acid to generate at least one amplicon. In such a method, the primer or primer pair can comprise a variant or fragment of one or more of the genomic loci provided herein.

In one embodiment, the method involves amplifying a variant or fragment of one or more polynucleotides associated with the Rps1a, Rps1c, Rps1d, or Rps1k loci comprising SEQ ID NOS: 155, 156, 157, 158, 159, 160, 161, 162, 163, 164, 165, 166, 167, 168, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 694, 695, 696, 697, 698, 699, 700, 701, 702, 703, 704, 705, 706, 707, 708, 709, 710, 711, 712, 713, 714, 715, 716, 717, 718, 719, 720, 721, 722, 723, 724, 725, 726, 727, 728, 729, 730, 731, 732, 733, 734, 735, 736, 737, 738, 739, 740, 741, 742, 743, 744, 745, 746, 747, 748, 749, 750, 751, 752, 753, 754, 755, 756, 757, 758, 759, 760, 761, 762, 763, 764, 765, 766, 767, 768, 769, 770, 771, 772, 773, 774, 775, 776, 777, 778, 779, 780, 781, 782, 783, 784, 785, 786, 787, 788, 789, 790, 791, 792, 793, 794, 795, 796, 797, 798, 799, 800, 801, 802, 803, 804, 805, 806, 807, 808, 809, 810, 811, 812, 813, 814, 815, 816, 817, 818, 819, 820, 821, 822, 823, 824, 825, 826, 827, 828, 829, 830, 831, 832, 833, 834, 835, 836, 837, 838, 839, 840, 841, 842, 843, 844, 845, 846, 847, 848, 849, 850, 851, 852, 853, 854, 855, 856, 857, 858, 859, 860, 861, 862, 863, 864, 865, 866, 867, 868, 869, 870, 871, 872, 873, 874, 875, 876, 877, 878, 879, 880, 881, 882, 883, 884, 885, 886, 887, 888, 889, 890, 891, 892, 893, 894, 895, 896, 897, 898, 899, 900, 901, 902, 903, 904, 905, 906, 907, 908, 909, 910, 911, 912, 913, 914, 915, 916, 917, 918, 919, 920, 921, 922, 923, 924, 925, 926, 927, 928, 929, 930, 931, 932, 933, 934, 935, 936, 937, 938, 939, 940, 941, 942, 943, 944, 945, 946, 947, 948, 949, 950, 951, 952, 953, 954, 955, 956, 957, 958, 959, 960, 961, 962, 963, 964, 965, 966, 967, 968, 969, 970, 971, 972, 973, 974, 975, 976, 977, 978, 979, 980, 981, 982, 983, 984, 985, 986, 987, 988, 989, 990, 991, 992, 993, 994, 995, 996, 997, 998, 999, 1000, 1001, 1002, 1003, 1004, 1005, 1006, 1007, 1008, 1009, 1010, 1011, 1012, 1013, 1014, 1015, 1016, 1017, 1018, 1019, 1020, 1021, 1022, 1023, 1024, 1025, 1026, 1027, 1028, 1029, 1030, 1031, 1032, 1033, 1034, 1035, 1036, 1037, 1038, 1039, 1040, 1041, 1042, 1043, 1044, 1045, 1046, 1047, 1048, 1049, 1050, 1051, 1052, 1053, 1054, 1055, 1056, 1057, 1058, 1059, 1060, 1061, 1062, 1063, 1064, 1065, 1066, 1067, 1068, 1069, 1070, 1071, 1072, 1073, 1074, 1075, 1076, 1077, 1078, 1079, 1080, 1081, 1082, 1083, 1084, 1085, 1086, 1087, 1088, 1089, 1090, 1091, 1092, 1093, 1094, 1095, 1096, 1097, 1098, 1099, 1100, 1101, 1102, 1103, 1104, 1105, 1106, 1107, 1108, 1109, 1110, 1111, 1112, 1113, 1114, 1115, 1116, 1117, 1118, 1119, 1120, 1121, 1122, 1123, 1124, 1125, 1126, 1127, 1128, 1129, 1130, 1131, 1132, 1133, 1134, 1135, 1136, 1137, 1138, 1139, 1140, 1141, 1142, 1143, 1144, 1145, 1146, 1147, 1148, 1149, 1150, 1151, 1152, 1153, 1154, 1155, 1156, 1157, 1158, 1159, 1160, 1161, 1162, 1163, 1164, 1165, 1166, 1167, 1168, 1169, 1170, 1171, 1172, 1173, 1174, 1175, 1176, 1177, 1178, 1179, 1180, 1181, 1182, 1183, 1184, 1185, 1186, 1187, 1188, 1189, 1190, 1191, 1192, 1193, 1194, 1195, 1196, 1197, 1198, 1199, 1200, 1201, 1202, 1203, 1204, 1205, 1206, 1207, 1208, 1209, 1210, 1211, 1212, 1213, 1214, 1215, 1216, 1217, 1218, 1219, 1220, 1221, 1222, 1223, 1224, 1225, 1226, 1227, 1228, 1229, 1230, 1231, 1232, 1233, 1234, 1235, 1236, 1237, 1238, 1239, 1240, 1241, 1242, 1243, 1244, 1245, 1246, 1247, 1248, 1249, 1250, 1251, 1252, 1253, 1254, 1255, 1256, 1257, 1258, 1259, 1260, 1261, 1262, 1263, 1264, 1265, 1266, 1267, 1268, 1269, 1270, 1271, 1272, 1273, 1274, 1275, 1276, 1277, 1278, 1279, 1280, 1281, 1282, 1283, 1284, 1285, 1286, 1287, 1288, 1289, 1290, 1291, 1292, 1293, 1294, 1295, 1296, 1297, 1298, 1299, 1300, 1301, 1302, 1343, 1345, 1346, 1347, 1348, 1349, 1350, 1351, 1352, 1353, 1354, 1355, 1356, 1357, 1358, 1359, 1360, 1361, 1362, 1363, 1364, 1365, 1366, 1367, 1368, 1369, 1370, 1371, 1372, 1373, 1374, 1375, 1376, 1377, 1378, 1379, 1380, 1381, 1382, 1383, 1384, 1385, 1386, 1387, 1388, 1389, 1390, 1391, 1392, 1393, 1394 or variants or fragments thereof. It is recognized that reference to any one of SEQ ID NOS: 191-1302 explicitly denotes each of the SEQ ID NOS recited above.

In one embodiment, the primer or primer pair can comprise a variant or fragment of one or more polynucleotides comprising SEQ ID NOS: 155, 156, 157, 158, 159, 160, 161, 162, 163, 164, 165, 166, 167, 168, 191-1302, 1343, 1345, 1346, 1347, 1348, 1349, 1350, 1351, 1352, 1353, 1354, 1355, 1356, 1357, 1358, 1359, 1360, 1361, 1362, 1363, 1364, 1365, 1366, 1367, 1368, 1369, 1370, 1371, 1372, 1373, 1374, 1375, 1376, 1377, 1378, 1379, 1380, 1381, 1382, 1383, 1384, 1385, 1386, 1387, 1388, 1389, 1390, 1391, 1392, 1393, 1394 or complements thereof. In specific embodiments, the primer or primer pair comprises a nucleic acid sequence comprising SEQ ID NOS: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 1339, 1340 or variants or fragments thereof. In a further embodiment, the primer pair comprises SEQ ID NO: 1 and SEQ ID NO:2; SEQ ID NO: 9 and SEQ ID NO:10; SEQ ID NO: 20 and SEQ ID NO:21; SEQ ID NO: 22 and SEQ ID NO: 23; SEQ ID NO: 24 and SEQ ID NO: 25; SEQ ID NO: 36 and SEQ ID NO: 37; SEQ ID NO: 38 and SEQ ID NO: 39; or SEQ ID NO: 1339 and SEQ ID NO: 1340.

In another embodiment, the method involves amplifying a variant or fragment of one or more polynucleotides associated with the Rps2 locus comprising SEQ ID NOS: 173, 174, 175, 176, 177, 178, 179, 180 or variants or fragments thereof. In one embodiment, the primer or primer pair can comprise a variant or fragment of one or more polynucleotides comprising SEQ ID NOS: 173, 174, 175, 176, 177, 178, 179, 180 or complements thereof. In specific embodiments, the primer or primer pair comprises a nucleic acid sequence comprising SEQ ID NOS: 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78 or variants or fragments thereof. In a further embodiment, the primer pair comprises SEQ ID NO: 40 and SEQ ID NO: 41; SEQ ID NO: 46 and SEQ ID NO: 47; SEQ ID NO: 52 and SEQ ID NO: 53; SEQ ID NO: 58 and SEQ ID NO: 59; SEQ ID NO: 64 and SEQ ID NO: 65; or SEQ ID NO: 75 and SEQ ID NO: 76.

In another embodiment, the method involves amplifying a variant or fragment of one or more polynucleotides associated with the Rps3a or Rps3c loci comprising SEQ ID NOS: 181, 182, 183, 184, 185, 186 or variants or fragments thereof. In one embodiment, the primer or primer pair can comprise a variant or fragment of one or more polynucleotides comprising SEQ ID NOS: 181, 182, 183, 184, 185, 186 or complements thereof. In specific embodiments, the primer or primer pair comprises a nucleic acid sequence comprising SEQ ID NOS: 79, 80, 81, 82, 83, 84, 85, 86, 87, 88, 89, 90, 91, 92 or variants or fragments thereof. In a further embodiment, the primer pair comprises SEQ ID NO: 81 and SEQ ID NO: 82; SEQ ID NO: 89 and SEQ ID NO: 90; or SEQ ID NO: 91 and SEQ ID NO: 92.

In yet another embodiment, the method involves amplifying a variant or fragment of one or more polynucleotides associated with the Rps6 locus comprising SEQ ID NOS: 187, 188, 189, 190 or variants or fragments thereof. In one embodiment, the primer or primer pair can comprise a variant or fragment of one or more polynucleotides comprising SEQ ID NOS: 187, 188, 189, 190 or complements thereof. In specific embodiments, the primer or primer pair comprises a nucleic acid sequence comprising SEQ ID NOS: 93, 94, 95, 96, 97, 98, 99, 100, 101, 102, 103, 104 or variants or fragments thereof. In a further embodiment, the primer pair comprises SEQ ID NO: 95 and SEQ ID NO: 96; or SEQ ID NO: 101 and SEQ ID NO: 102.

The method further comprises providing one or more labeled nucleic acid probes suitable for detection of each marker locus being amplified. In such a method, the labeled nucleic acid probe can comprise a sequence comprising a variant or fragment of one or more of the genomic loci provided herein.

In one embodiment, the labeled nucleic acid probe can comprise a sequence associated with the Rps1a, Rps1c, Rps1d or Rps1k loci comprising a variant or fragment of one or more polynucleotides comprising SEQ ID NOS: 155, 156, 157, 158, 159, 160, 161, 162, 163, 164, 165, 166, 167, 168, 191-1302, 1343, 1345, 1346, 1347, 1348, 1349, 1350, 1351, 1352, 1353, 1354, 1355, 1356, 1357, 1358, 1359, 1360, 1361, 1362, 1363, 1364, 1365, 1366, 1367, 1368, 1369, 1370, 1371, 1372, 1373, 1374, 1375, 1376, 1377, 1378, 1379, 1380, 1381, 1382, 1383, 1384, 1385, 1386, 1387, 1388, 1389, 1390, 1391, 1392, 1393, 1394 or complements thereof. In specific embodiments, the labeled nucleic acid probe comprises a nucleic acid sequence comprising SEQ ID NOS: 105, 106, 107, 108, 109, 110, 112, 113, 114, 115, 116, 117, 118, 119, 120, 121, 122, 123, 124, 125, 126, 127, 1341, 1342 or variants or fragments thereof.

In another embodiment, the labeled nucleic acid probe can comprise a sequence associated with the Rps2 locus comprising a variant or fragment of one or more polynucleotides comprising SEQ ID NOS: 173, 174, 175, 176, 177, 178, 179, 180 or complements thereof. In specific embodiments, the labeled nucleic acid probe comprises a nucleic acid sequence comprising SEQ ID NOS: 128, 129, 130, 131, 132, 133, 134, 135, 136, 137, 138, 139 or variants or fragments thereof.

In another embodiment, the labeled nucleic acid probe can comprise a sequence associated with the Rps3a or Rps3c loci comprising a variant or fragment of one or more polynucleotides comprising SEQ ID NOS: 181, 182, 183, 184, 185, 186 or complements thereof. In specific embodiments, the labeled nucleic acid probe comprises a nucleic acid sequence comprising SEQ ID NOS: 140, 141, 142, 143, 144, 145, 146, 147, 148, 149 or variants or fragments thereof.

In yet another embodiment, the labeled nucleic acid probe can comprise a sequence associated with the Rps6 locus comprising a variant or fragment of one or more polynucleotides comprising SEQ ID NOS: 187, 188, 189, 190 or complements thereof. In specific embodiments, the labeled nucleic acid probe comprises a nucleic acid sequence comprising SEQ ID NOS: 150, 151, 152, 153, 154 or variants or fragments thereof.

Non-limiting examples of primers, probes, genomic loci and amplicons that can be used in the methods and compositions provided herein are summarized in Tables 2, 3, 4 and 5, respectively.

TABLE 2

Non-Limiting Examples of Primer Sequences.

| Marker position* | Gene/ Locus | LG Locus | TaqMan Assay Name | Primer Name | SEQ ID NO | Primer Sequence | Allele (R/S) |
|---|---|---|---|---|---|---|---|
| 3905604 | Rps1a | N S08291-1 | Q5 | S08291-F3 | 1 | AAAAATGCCTCGTGGAGAGA | G/A |
|  |  |  | Q5 | S08291-R3 | 2 | GAAAATATGTAAAAGAAGAACTGCCAGA | G/A |
|  |  |  | Q1 | S08291-F1 | 3 | TGGAGAGACAAAACAGGAGATTT | G/A |
|  |  |  | Q1 | S08291-R1 | 4 | ATACACAATGGAAGATTGTTTAGCA | G/A |
|  |  |  | Q4 | S08291-F2 | 5 | GAAAGAGAAACTGGGATTCTGG | G/A |
|  |  |  | Q4 | S08291-R2 | 6 | TATACACAATGGAAGATTGTTTAGCA | G/A |
|  |  |  | Q6 | S08291-F4 | 7 | CCTCGTGGAGAGACAAAACAG | G/A |
|  |  |  | Q6 | S08291-R4 | 8 | CGAGAAAATATGTAAAAGAAGAACTGC | G/A |
| 4464524 | Rps1c | N S07292-1 | Q7 | S07292-F5 | 9 | AGATTCAAGGAGTCCAGACGAT | T/G |
|  |  |  | Q7 | S07292-R6 | 10 | CTCCAGCGGGAGATTTGC | T/G |
|  |  |  | Q1, Q2 | S07292-F1 | 11 | TCAAGGAGTCCAGACGATGC | T/G |
|  |  |  | Q1, Q2 | S07292-R1 | 12 | YGTCATGCTCAAGCTGTTCG | T/G |
|  |  |  | Q3, Q4 | S07292-F2 | 13 | AAGCTGCCAAGGGACAATTA | T/G |
|  |  |  | Q3 | S07292-R2 | 14 | CGGGAGATTTGCTTCTTCAA | T/G |
|  |  |  | Q4 | S07292-R3 | 15 | CAAGCTAGTAAGGCCATTTTGC | T/G |
|  |  |  | Q5 | S07292-F3 | 16 | CTGCCAAGGGACAATTAGACTT | T/G |
|  |  |  | Q5 | S07292-R4 | 17 | CCAGCGGGAGATTTGCTT | T/G |
|  |  |  | Q6 | S07292-F4 | 18 | ATTCAAGGAGTCCAGACGATG | T/G |
|  |  |  | Q6 | S07292-R5 | 19 | CTAGTAAGGCCATTTTGCTTCAG | T/G |
| 4343300 | Rps1c | N S08242-1 |  | Primer 1 | 20 | CTTGCATTCTGGAGGTGCTA | C/T |
|  |  |  |  | Primer 2 | 21 | CCATCCCCTATTCTTTGGTG | C/T |
| 3904033 | Rps1d | N S16592-001 |  | S1659 2-F001 | 1339 | GGGAAGAATCCCAGTTGGAG | A/T |
|  |  |  |  | S1659 2-R001 | 1340 | CAAACAAACTTGCGTTGCAG | A/7 |
| 3951705 | Rps1k | N S07963-2 | Q1 | S07963-F2 | 22 | ATGAGGACACAATGCCATGA | T/C |
|  |  |  | Q1 | S07963-R2 | 23 | TGAGAAGGCCAATCCTATGC | T/C |
| 5227883 | Rps1k | N S07372-1 | Q11, Q6, Q8, Q12 | S07372-F5 | 24 | ATTTTGGGCAAATGATGAAGC | C/T |
|  |  |  | Q11, Q8, Q12 | S07372-R4 | 25 | CTCAGCTAAAGACACCCTGCAAT | C/T |
|  |  |  | Q2, Q7 | S07372-F1 | 26 | TTGGGCAAATGATGAAGCTA | C/T |
|  |  |  | Q2, Q3, Q4 | S07372-R2 | 27 | GAGGGCTCATCAGCACAAA | C/T |
|  |  |  | Q3 | S07372-F2 | 28 | AAATGGTTTGTGGGAGGTTAGA | C/T |
|  |  |  | Q4 | S07372-F3 | 29 | AGAATAAATGGTTTGTGGGAGGTTA | C/T |
|  |  |  | Q5 | S07372-F4 | 30 | TGAAGATATGCAAATTCTTTTCAAATTA | C/T |
|  |  |  | Q5 | S07372-R3 | 31 | ACCATGGAGGGCTCATCA | C/T |
|  |  |  | Q6 | S07372-R4 | 32 | CTCAGCTAAAGACACCCTGCAAT | C/T |
|  |  |  | Q7 | S07372-R1 | 33 | CAAAAGGGCATCCTCAAAAG | C/T |
|  |  |  |  | 86061 | 34 | TGGGAGGTTAGATTTTCTGAACGAAGA | C/T |
|  |  |  |  | 82582 | 35 | CATCAGCACAAAAGGGCATCCTCA | C/T |
| 3927056 | Rps1k | N S00009-01 |  | Primer 1 | 36 | TGACACGTGGTGCGTTAGGAATTTT | C/T |
|  |  |  |  | Primer 2 | 37 | TGAAACGCATTAGTTCAGGTGGTAACTTCT | C/T |
| 4458273 | Rps1k | N S08013-1 | Q1 | S08013-F1 | 38 | GAAAACGAAAATTGTAAGAGCAACTT | C/T |
|  |  |  | Q1 | S08013-R1 | 39 | ATGGAATGAGTTTGGGATGG | C/T |
| 36085130 | Rps2 | J S06862-1 | Q1 | S06862-1-Q1F | 40 | CCAAAGCTGTCTTGGAGGAA | T/G |
|  |  |  | Q1 | S06862-1-Q1R | 41 | CAAAACAGATGCTTTTAACATGAAC | T/G |
|  |  |  | Q2 | S06862-1-Q2F | 42 | GCTGTCTTGGAGGAACTTGAA | T/G |
|  |  |  | Q2 | S06862-1-Q2R | 43 | TTTCACAACACGAGGCTGTC | T/G |

TABLE 2-continued

Non-Limiting Examples of Primer Sequences.

| Marker position* | Gene/ Locus | LG Locus | TaqMan Assay Name | Primer Name | SEQ ID NO | Primer Sequence | Allele (R/S) |
|---|---|---|---|---|---|---|---|
| | | | Q3 | S06862-1-Q3F | 44 | GTTGCCAAAGCTGTCTTGGA | T/G |
| | | | Q3 | S06862-1-Q3R | 45 | CACGAGGCTGTCTACTCTCTTCA | T/G |
| 36692217 | Rps2 | J S06863-1 | Q1 | S06863-1-Q1F | 46 | TCACACAAGGAAATTTAACACTACAT | G/A |
| | | | Q1 | S06863-1-Q1R | 47 | TTCTCACCTTCTGTTGTATTGGA | G/A |
| | | | Q2 | S06083-1-Q2F | 48 | CGCCAAATGGCTTACTTCTC | G/A |
| | | | Q2 | S06863-1-Q2R | 49 | ACCAATGAATCACACAAGGAAA | G/A |
| | | | Q3 | S06863-1-Q3F | 50 | GGCGCCAAATGGCTTACT | G/A |
| | | | Q3 | S06863-1-Q3R | 51 | TGAATCACACAAGGAAATTTAACACT | G/A |
| 37262813 | Rps2 | J S06864-1 | Q1 | S06864-1-Q1F | 52 | AACCATGCCCTTGAACAGTC | T/C |
| | | | Q1 | S06864-1-Q1R | 53 | TTTGTGAAGGACATTTTGATTTG | T/C |
| | | | Q2 | S06864-1-Q2F | 54 | TGAACAGTCTGCCCTCAGAA | T/C |
| | | | Q2 | S06864-1-Q2R | 55 | TCTCAAAATCGGCATGAGGT | T/C |
| | | | Q3 | S06864-1-Q3F | 56 | CCTTGAACAGTCTGCCCTCA | T/C |
| | | | Q3 | S06864-1-Q3R | 57 | TGAACTTTGTGAAGGACATTTTGA | T/C |
| 37377161 | Rps2 | J S06865-1 | Q1 | S06865-1-Q1F | 58 | 59 | G/A |
| | | | Q1 | S06865-1-Q1R | 59 | TTTGTGCAATTCTCCCATCA | G/A |
| | | | Q2 | S06865-1-Q2F | 60 | TGTTTACACGTTCTCCAATCAAA | G/A |
| | | | Q2 | S06865-1-Q2R | 61 | TGTGCAATTCTCCCATCAAA | G/A |
| | | | Q3 | S06865-1-Q3F | 62 | CAAGTGTTGTTTACACGTTCTCCA | G/A |
| | | | Q3 | S06865-1-Q3R | 63 | TTCCATAGGTGCTGTTTGTGC | G/A |
| 36775973 | Rps2 | J S11652-1 | Q1 | S11652-F1 | 64 | TTTCACTGCAAGAGGGAAGG | G/T |
| | | | Q1, Q4 | S11652-R1 | 65 | ATTCCTGCAGCTTCTCCATC | G/T |
| | | | Q2 | S11652-F2 | 66 | GAAGGGCTGTTGGTTATACCG | G/T |
| | | | Q2 | S11652-R2 | 67 | CATCTTATCTTTGAACCTTTCCTGA | G/T |
| | | | Q3 | S11652-F3 | 68 | AGGGAAGGGCTGTTGGTT | G/T |
| | | | Q3 | S11652-R3 | 69 | TCCATCTTATCTTTGAACCTTTCC | G/T |
| | | | Q4 | S11652-F4 | 70 | GCAAGAGGGAAGGGCTGTT | G/T |
| 36563064 | Rps2 | J S11682-1 | Q1 | S11682-F1 | 71 | ACAACACCTCCAGAGCATCC | G/T |
| | | | Q1 | S11682-R1 | 72 | GCTTGTCAACATCATCTAAAATCAA | G/T |
| | | | Q2 | S11682-F2 | 73 | GGTTACAACACCTCCAGAGCA | G/T |
| | | | Q2 | S11682-R2 | 74 | TGCTTGTCAACATCATCTAAAATCA | G/T |
| | | | Q3 | S11682-F3 | 75 | CTCCAGAGCATCCTTCTTCG | G/T |
| | | | Q3 | S11682-R3 | 76 | TCATGCTTGTCAACATCATCTAAA | G/T |
| | | | Q4 | S11682-F4 | 77 | CAACACCTCCAGAGCATCC | G/T |
| | | | Q4 | S11682-R4 | 78 | GATGATGACTCTACTGCCTGGA | G/T |
| 29110641 | Rps3a | F S09018-1 | Q1 | S09018-F1 | 79 | AAGTGGCAGAGTGAACAGCA | C/G |
| | | | Q1 | S09018-R1 | 80 | TAAGCGCATTTTCAAAGCTG | C/G |
| | | | Q2 | S09018-F2 | 81 | GACCGTAGAGAAAGTGGCAGA | C/G |
| | | | Q2 | S09018-R2 | 82 | AATAAGCGCATTTTCAAAGCTG | C/G |
| | | | Q3 | S09018-F3 | 83 | GGAGGAAAGGACCGTAGAGAA | C/G |
| | | | Q3 | S09018-R3 | 84 | AGCGCATTTTCAAAGCTGA | C/G |
| | | | Q4 | S09018-F4 | 85 | TGTTGCTCTTCCAAAAGATGAC | C/G |
| | | | Q4 | S09018-R4 | 86 | TGCATAACGTTTCAGAAGGAAA | C/G |
| | | | Q5 | S09018-F5 | 87 | CCAGTGAACTATGTTGCTCTTCC | C/G |
| | | | Q5 | S09018-R5 | 88 | CCAAATTTACAATGCATAACGTTTC | C/G |

TABLE 2-continued

Non-Limiting Examples of Primer Sequences.

| Marker position* | Gene/ Locus | LG Locus | TaqMan Assay Name | Primer Name | SEQ ID NO | Primer Sequence | Allele (R/S) |
|---|---|---|---|---|---|---|---|
| 29049150 | Rps3a | F S08342-1 | | Primer 1 | 89 | AAAGAAGTTTAATTTGCAAATAGCTTG AATTTTTCAAA | [T/A]/ [T/C]/ [C/A] |
| | | | | Primer 2 | 90 | TACTCCAATCAAGTTTCCATGGCAAAG TTAG | [T/A]/ [T/C]/ [C/A] |
| 29049184 | Rps3c | F S07163-1 | Q1-Q4 | S07163- 1-F1 | 91 | CAGGAAAGTTGAATTGCTTTATCC | T/C |
| | | | Q1-Q4 | S07163- A-R1 | 91 | CAGAGTTTCCATGGCAAAGTTA | T/C |
| 60745556 | Rps6 | G S08442-1 | Q5 | S08442-F3 | 93 | GGCCTTTTGTTATTTCTTCAGC | T/C |
| | | | Q5 | S08442-R4 | 94 | GAGTATGGAGACAGCCCACAA | T/C |
| | | | Q4 | S08442-F1 | 95 | CACATTATAGGGGCCTTTTGTTA | T/C |
| | | | Q4 | S08442-R3 | 96 | TTGCATATTTTCTCCCACCTG | T/C |
| | | | Q1 | S08442-F1 | 97 | CACATTATAGGGGCCTTTTGTTA | T/C |
| | | | Q1 | S08442-R1 | 98 | TTAGCTTGTGTAGAGTATGGAGACAG | T/C |
| | | | Q2 | S08442-F2 | 99 | AGGGGCCTTTTGTTATTTCTTC | T/C |
| | | | Q2 | S08442-R2 | 100 | TTTCTCCCACCTGTGCATT | T/C |
| 60777851 | Rps6 | G S08341-1 | | p10792- 6-F2 | 101 | CGTCCGAGATTGGAAATTGT | [A/T]/ [G/T] |
| | | | | p10792- 6-R4 | 102 | TGGACTTTGGAATTGAACCAG | [A/T]/ [G/T] |
| | | | | p10792- 6-R2 | 103 | TGTGAGACAAACTCCTGCATAAA | [A/T]/ [G/T] |
| | | | | p10792- 6-R3 | 104 | TTATTGTGAGACAAACTCCTGCAT | [A/T]/ [G/T] |

*Physical positions are based on Public JGI Glyma1 Williams82 reference.

TABLE 3

Non-Limiting Examples of Probe Sequences.

| Marker Position* | Gene/ Locus | LG | Marker Name | Probe 1 Name | Probe 1 SEQ ID NO | Probe 1 Sequence | Probe 2 Name | Probe 2 SEQ ID NO | Probe 2 Sequence |
|---|---|---|---|---|---|---|---|---|---|
| 3905603 | Rps1a | N | S08291-1 | S08291- 1-PB1 | 105 | 6FAM-CCTCACA TACACATCAG | S08291- 1-PB2 | 106 | VIC-CCTCACATA CACATTAG |
| 3905604 | Rps1a | N | S08291-1 | S08291- 1-PB3 | 107 | 6FAM-ACATACA CATCAGCAAC | S08291- 1-PB4 | 108 | VIC-ACACATTAG CAACCC |
| 3905604 | Rps1a | N | S08291-1 | S08291- 1-PB5 | 109 | 6FAM-TCACATA CACATCAGCA | S08291- 1-PB6 | 110 | VIC-TCACATACA CATTAGCA |
| 4464524 | Rps1c | N | S07292-1 | S07292- 1-PB1 | 111 | 6FAM-TTGCCAA CCTGATAGA | S07292- 1-PB2 | 112 | VIC-CCAACCTGA TCGAGA |
| 4464524 | Rps1c | N | S07292-1 | S07292- 1-PB3 | 113 | 6FAM-TTCTCTA TCAGGTTGGC | S07292- 1-PB4 | 114 | VIC-TTGCACATC TTCTCGAT |
| 4343399 | Rps1c | N | S08242-1 | Probe 1 | 115 | 6FAM-TTCCCTG TGTTTGC | Probe 2 | 116 | VIC-TTCCCTGCG TTTGC |
| 3904033 | Rps1d | N | S16592- 001 | S16592- 001- X001 | 1341 | 6FAM-tcatcTg tcccgatcc | S16592- 001- X002 | 1342 | VIC-tcatcAgtc ccgatcc |
| 3951705 | Rps1k | N | S07963-2 | S07963- 2-PB1 | 117 | CCAGATCATATA TCGC | S07963- 2-PB2 | 118 | CAGATCACATATC GC |
| 5228883 | Rps1k | N | S07372-1 | S07372- 1-PB5 | 119 | 6FAM-CTCCTTA AGGTAATTAA | S07372- 1-PB4 | 120 | VIC-AGCACTCCT TAAGATAA |
| 5227883 | Rps1k | N | S07372-1 | 102408 | 121 | 6FAM-CACTCCT TAAGGTAAT | 102409 | 122 | VIC-CACTCCTTA AGATAAT |

TABLE 3-continued

Non-Limiting Examples of Probe Sequences.

| Marker Position* | Gene/ Locus | LG | Marker Name | Probe 1 Name | Probe 1 SEQ ID NO | Probe 1 Sequence | Probe 2 Name | Probe 2 SEQ ID NO | Probe 2 Sequence |
|---|---|---|---|---|---|---|---|---|---|
| 5227883 | Rps1k | N | S07372-1 | S07372-1-PB5 | 119 | 6FAM-CTCCTTA AGGTAATTAA | 148644 | 123 | VIC-AGCACTCCT TAAGATAA |
| 3927056 | Rps1k | N | S00009-01 | Probe 1 | 124 | 6FAM-CATGTGG CTCAATTT | Probe 2 | 125 | VIC-CATGTGGCT TAATTT |
| 4458273 | Rps1k | N | S08013-1 | S08013-1-PB1 | 126 | TCATCTTTTCAT CCAGTGC | S08013-1-PB2 | 127 | ATCTTTTCATTCA GTGCAT |
| 36085130 | Rps2 | J | S06862-1 | S06862-1-FAM | 128 | 6FAM-CTTACTT TTGCACATGTA | S06862-1-VIC | 129 | VIC-TAGCTTGTT GGTTGCAC |
| 36692217 | Rps2 | J | S06863-1 | S06863-1-FAM | 130 | 6FAM-TTTGGAA CTGCACCTC | S06863-1-VIC | 131 | VIC-TTTGGAATT GCACCTCA |
| 37262813 | Rps2 | J | S06864-1 | S06864-1-FAM | 132 | 6FAM-CTGCTGT ACTAATCATAT | S06864-1-VIC | 133 | VIC-CTGCTGTAC TAGTCATAT |
| 37377161 | Rps2 | J | S06865-1 | S06865-1-FAM | 134 | 6FAM-ATGCAAA TTTCTATCTTG | S06865-1-VIC | 135 | VIC-ATGCAAATT TTTATCTTGC |
| 36775973 | Rps2 | J | S11652-1 | S11652-1-PB1 | 136 | 6FAM-CAAAGTC GATCCTTC | S11652-1-PB2 | 137 | VIC-CTTTTACAA AGTAGATCCT |
| 36563064 | Rps2 | J | S11682-1 | S11682-1-PB1 | 138 | 6FAM-CAACATC GGCTTCA | S11682-1-PB2 | 139 | VIC-ACAACATAG GCTTCA |
| 29110641 | Rps3a | F | S09018-1 | S09018-1-PB1 | 140 | 6FAM-CTAATTT GACTCCTGAATC | S09018-1-PB2 | 141 | VIC-CTAATTTGA CTCGTGAATC |
| 29049150 | Rps3a | F | S08342-1 | Probe 1 | 142 | 6FAM-ACCATAC TAAAAAATT | Probe 2 | 143 | VIC-ACCATACTC AAAAAT |
| 29049184 | Rps3c | F | S07163-1 | S07163-1-P1 | 144 | 6FAM-GGAACGT TACCGGA | S07163-1-P2 | 145 | VIC-TGGAACATT ACCGGAC |
| 290491843 | Rps3c | F | S07163-1 | S07163-1-PB1 | 146 | 6FAM-TGGGTCC GGTAACGT | S07163-1-PB2 | 147 | VIC-TCCGGTAAT GTTCC |
| 29049184 | Rps3c | F | S07163-1 | S07163-1-PB3 | 148 | 6FAM-TGGAACG TTACCGGAC | S07163-1-PB4 | 149 | VIC-CGTGGAACA TTACC |
| 60745556 | Rps6 | G | S08442-1 | S08552-1-PB1 | 150 | 6FAM-CAAATTA ACACATCAACA | S08442-1-PB2 | 151 | VIC-CAAATTAAC ACGTCAACA |
| 60777851 | Rps6 | G | S08341-1 | 102379 (allele 1) | 152 | 6FAM-ATCTTTT TGGAAGTTATAC | 102380 (allele 2) | 153 | VIC-TCTTTTTGG AAGATATAC |
| 60777851 | Rps6 | G | S08341-1 | 102381 (allele 3) | 154 | 6FAM-CATCTTT TTGGAATATATA C | | | |

*Physical positions are based on Public JGI Glymal Williams82 reference.

TABLE 4

Non-Limiting Examples of Genomic Loci Comprising the Various Marker Loci Provided Herein.*

| Marker Name | Gene/ Locus | LG | Ref. Seq. SEQ ID NO (R/S) | Reference Sequence |
|---|---|---|---|---|
| S08291-1 | Rps1a | N | 155/156 | TYSRWAATGGGGCCACCCATATTATTTTGCTACCGAAATAGAATA CGAAAATGGGGGTAGTGACCTTRTGGCCATAGAGTTGAAGCAAGC TAATTCTGACWCGTGGCTTCCCATGCAGCGTTCATGGGGTGCAAG GTGGGCTTTGAATTTAGGTTTTACAATTACAAGCACCATTATCTAT TAAGCTCACAGAACAAGGCAAGGGCTATTACAAGACAATTGTGGC TGATAGTGTAATTCCACATGGCTGGCAACCTGGCCAAGTTTATCG ATCTGTTGTTAATTTTTAAACTCTGTTTAAAATCATGACATCAAT CGAGAAAATATGTAAAAGAAGAACTGCCAGATTATATAAATAAGT |

TABLE 4-continued

Non-Limiting Examples of Genomic Loci Comprising
the Various Marker Loci Provided Herein.*

| Marker Name | Gene/ Locus | LG | Ref. Seq. SEQ ID NO (R/S) | Reference Sequence |
|---|---|---|---|---|
| | | | | TTATCCTTGTCAGTTCATATATATATACACAATGGAAGATTGTTT AGCAATAWTTCTTTGCATTTCTTTTATGTGATAAAAAGTATGTGT AATAATATGGGGGTTGCT[G/A]ATGTGTATGTGAGGTTGTGAAA CTTTGTTTTAAATAAAAATAATTCAAATCTCCTGTTTTGTCTCT CCACGAGGCATTTTTTCCTAATAAYCCAGAATCCCAGTTTCTCTT TCCCRTGAACACTTCCTTCTTCTTGGTTTGCAGTTTTTTAAAATA AAAGGTTATTATTTTCTATAAAAAAAATGAAAAGCAATCACCTGC AAGACATGGTCATAGCCKKTT |
| S07292-1 | Rps1c | N | 157/158 | ATTGKTKGTSTGKKCCTVSMYRTTTGAAGCTGAATTTGTTTGCTG CTCTGTTATCAAGCTAGTAAGGCCATTTTGCTTCAGRTAGGTCTC CAGCGGGAGATTTGCTTCTTCAAGAAGACTYGTCATGCTCAAGCT GTTCGGCCCAGCTTGCACATCTTCTC[T/G]ATCAGGTTGGCAAT TCAAGTCTAATTGTCCCTTGGCAGCTTCAGCCACCGCATCGTCTG GACTCCTTGAATCTAATTCATTTTGCACCCTTACTTCATTCTCCA AACCGTCAACTGGAGTTAAATGCGAGAGGTGCTATCTACTTCTG ATTCATCTTTCGTCCGCCATGATAACTGATTTCTCTGAGCAATCT CTGCTTCACGTTCRGATTGCYGCTTCTYCTTTCGCAKCATCAGGG TTTTAAACCGACGTTTAACTGTCATGCACACATTGCAGGTGCATG TAGGTTTGTGTTTGCCCTTCCCACTTGGTGGCTGGATACARACAA TGCAAGAGCACCCAGGTCTATGCCGAGGATGTTTTGTGGTGGTAA CAACTGGTGTTCTGCCAGAGTCACTTGCATCATCTCCCAGTATTG CTGCATTTGCCATGGTCATAG |
| S08242-1 | Rps1c | N | 159/160 | GCAAGCCTGCTTCAAGGACTTGCGTGGTGCACGTATGAAGAATAG TGGCGTGAATGGGAGCTAACCTGGATTGTGAAAATGGAATACAAA TTGCAAAATCATCAATGATTTYTAGAATATTTCCTTTATACAAAA TGACAAATTCTATTATTAGGGAAGTGGTATAAATAAAAGCATTTG TAAACCATTGAGGGATATGAATGAACAAAATACAAGCTTCCTTTC CTTCRGTGCCTTTTTCTCTCTTCTTCTTCCTTGCATTCTGGAGGT GCTAGTCCCGAATCCAGCAATTTCCCTG[C/T]GTTTGCACGTAA CATAGTTTCTAGTATTAGTTAAAGGGCAAAACTAAAAAATATGTG CACCAAAGAATAGGGGATGGTTAGTTTTTATGTTAGAATCTTACG ACAATTTGAACCTACTATCTCTTCTACTTTTTCTTTTAACACTTA ATTTTTTTTYKATCATTAAATTAATTTTATATCTTTGGATATTT TATTTATTATTATTAATTATTAAAAGAAAGWGCAGAGAGTATTGT TAGCATTTCTATTATAATTAATCTGAAATTGAACAATGTATGTAT TCAACAAAACAGTGAAGCAGTGAATTTGAAGATGGAAGGAATCAA GAAAGTACAAGTG |
| S16592-001 | Rps1d | N | 1343 | CRCCGGAGTGTCCAYKGGTGTTGAGTCCTAATATTTCTTTGTGSC TCTAGGTCATGATTTAAATACTTAAAGACCCTTGAAAATTTACAA ACAAACTTGCGTTGCAGATATATTTCAAAACCCTAGCATACRTCT AGCATGGGAGGGGTGCAACCAGTCACTACAAAAATCATTTGAAAA AATTAATTGCGGATCGGGACWGATGACAACTGTGCGTACCTTAAA GGGAAYCAGCRAATGAGAGGGTACATATAAAATTGAAGGTGTGAA ACTCCTAGCCTCCAACTGGGATTCTTCCCRCAAGTGTCGTTTGAA GTTAAGCCGCAAAAGAAGCTATGACTGGCTATGGYTGGCTATGGG GGGTTGTGCACGTTGTCCTGGGTTAGGGTATATATTGTATA |
| S07963-2 | Rps1k | N | 161/162 | CTTTCTYYTTNGCTTTTcnGAGAAGAAGAGATAAGATCAACCAAA GAATGAAGGAATTGCAAAAGCTGGTCCCAAATTCCAGTAAGGTAA AGAAAGAATGGTTGTAACTTAGCCAAGTTTTTGGTATAAAATTAT GTTCCCAATCTTTTTTCAAATTCTCTATTATGTAAGAAAGTGGCC ATACGTAACATGATAAAGCTGCAACATTGATCCTCTCTTTAATTT CTTTCCCTGTTCACCAATTAATCGGTTCAGTGGTCCCATGAGGAC ACAATGCCATGAASCCCAGATCA[T/C]ATATCGCATCTCCWTAT AGTATATGTTTCATTTTGTGTCTGCATAGGATTGGCCTTCTCATA AAGCAAACGCATTTCAGAAATCAATTGGAATCCTTTTATRTCTCT TTGAAGAACTTCTTAAAGGAATATGTGCCTAAATGACAAAATTCA GTTTCAATCTTTAAGTTTGYTCGAAATAAAAAGGTTTCACTTTTG ATTAATAATTGAGTTACTAACASAAAGACAATTAGACTCTATGTC TACACATCTTGGTGAGAATCCTCTACTGACTACTGATAAGATAAT ACTTTTAGATCCGATTGATACATTGTTGTAGTTTAATTATCATTC TCGAGTTTAAGTTTTTGATATGAATTACATTATATTGCAAAGWAA ATTTTGTCTAGTATTATATGATTACTGAWAATATTAATATTGGA GAGAAAATTGCCYYTCACATGGTCATA |
| S07372-1 | Rps1k | N | 163/164 | CTGCAGTGTTGTCTCTCGGAGTTGCTTCAATTGCTCATACTCTTT GGGATAACCACTCATTTCAAAGATGTACTAGTTTAAAACATGCAA AAAGA:TAAAGTTAATGTGTATTTTGTATGTTGTAGGGAAGCACA AAGTATCTTGATTGAATTAGGAAGATTACACGAGCCGTATGCATC AGAATAAATGGTTTGTGGGAGGTTAGATTTTCTGAACGAAGATGA |

TABLE 4-continued

Non-Limiting Examples of Genomic Loci Comprising the Various Marker Loci Provided Herein.*

| Marker Name | Gene/ Locus | LG | Ref. Seq. SEQ ID NO (R/S) | Reference Sequence |
|---|---|---|---|---|
| | | | | AGATATGCAAATTCTTTTCAAATTAATTTTGGGCAAATGATGAAG CTAGACTGATAATTGATTAATTTTGGGCAAATAATATTATATTAC ATGTATGAGATTGATTTTAAGTGTATATGCATACATGAAGCAATA GACTTAATTTAATTA[C/T]CTTAAGGAGTGCTGGACTTTTGAGG ATGCCCTTTTGTGCTGATGAGCCCTCCATGGTTGACATACAAAGC AAATTGCAGGGTGTCTTTAGCTGAGGTTTTTGCTGCTTCGAAGTG GCAATTGAATCAGCTCCGTTGGACAGTGACATGGTGATGGTGGTG ATAATTAATTCGGCTTAAGGGTAAGTACAACTTCTTAGCTCTGTA AGCAAAGGATGCCTTGTGGAGTTGGTTCATCTAATCCACGTATAT ATAGGGCTGAACGAGGGAACAAGAGTTTTCAATCAATGATTACAA TTCCACACTCTCGCCTCTAAAGTGCATCCCTCACATTGAAGCATC CTCCAAATCCCAAAATATTATTATTACCACTTAAAGCTATTACAA ATCAGAAAACACTGCAG |
| S00009-01 | Rps1k | N | 165/166 | TCAAAGTANNNNAAGTTATTAGACATGAAATTGTTTAWGATAAAT AATCTATTGTAATTAAGCAAGCCATGTTGGGCTAGGAACACTATC AACTAGTAGGATTTAAGTCTAGTCTCTTTAAGCGAATTTACAAGT TTATGGATAGCATTCAATGTATTTCTTAAGGTGGTATCACCCTCG WTGATMATTTTCACAAATTGACACGTGGTGCGTTAGGAATTTTGT TTTTTAATAATTTTCCACAYTAAAAAGTGATTTTCATGTGGCT[C/ T]AATTTTTTTTAAAAAAAAAATTGAATTAACACTMATGTGACA TTTTTATGTGGAACATGTCAACCTATATAAGTAATAATTTAGAAG TTACCACCTGAACTAATGCGTTTCAAATTCAAATGATAATATATG ATTTATGTGACTGYTAGTTCATTTTATTTAAAAAATATTMAMAAR ATCACWAGAMAYTRKMAATTGTCAATTCACKATTTGATAATGATA TGACAAATAATTCCATATTAGTAAATTWTTTCAAAATAATTCCCT TGTAATATTTCAAAATAGGATAAAYTACCATATTTGAGTCATTAA TTGTGTAAGCGTGGTCGCATTAATCC |
| S08013-1 | Rps1k | N | 167/168 | YYCTNANANTTGTTTACATCTTATACAGAACTTGAGTTTGAAAAC GAAAATTGTAAGAGCAACTTTTAATCATCTTTTCAT[C/T]CAGT GCATGCTTGAAAACTTTGTCAGAAGACAAATTAGTGKAAGCATAT ATATTAATTTCAATAATTTATTATGGAATTATCATATGATACCAT CCCAAACTCATTCCATGTTTCCCAAACAGAATGAATAATGATATT ASGCACCGTTCAAATTCAACATGATTTTGACAATARAAATCCAGC CAGATTAAATTTTTGTTCCACTATATCTCACACAAGCTTTACAAT CGGACAAACTGGTTACTATACAACTACTATGTTTTTTCTTTTCTT TTCTTTTAATCTCTGTTCCCATTTTATCACAAGTATTTCTTTTTT GTCATTTATWAAAAAAAAANGTAAGRAAAATTAATACTGTAAATTA TAAAYACATGCCATATAAAANTTGTGTAAAAAAANNAAATAAACG CATNGCCATATNNAAAAACACATGTCATAAANCAACGTTTTAAA TTGTGGTNCTCTNGGTCAGCAGCCACWTGG |
| S06862-1 | Rps2 | J | 169/170 | TGTTTTGTTACGCTTCTTTTTTGTACACAGTTATGCCAATTTTGA TTCTTGTTTTAATTATGTGTTGTGTGGCTTGGTTTTGTGTTTCA GTGACTCGTGCTATTGTTCCGAGAATGAACTTGGACGAGCTGTTT GAGCAGAAGGGTGAGGTTGCCAAAGCTGTCTTGGAGGAACTTGAA AAGGTATCTTACTTCTTTTATTTAAGTAAGTTCTGGCATTCTTGA ATTAAATATGTAAGAAAAGTGAAGAGAAGCTTAGTATTAGTTGTT GTTCACAAAATATCAAATTATTTCATTTCCTTTTAAAATTATACT AGCTTGTTG[T/G]TTGCACATGTAAAAGAGTTCATGTTAAAAGC ATCTGTTTTGAAGTACTGGTGAAGAGAGTAGACAGCCTCGTGTTG TGAAAAGGGTTGGGGGAGGGGGGGTGGACTAAGAAGGACTTTGG AGGAAATTGTTAAAAGGGACCTCGTCTTAANTNNTNTTCCNGAAA NTTGGNNNTNNCNTNNCNCANNGATNTCNNGTGNNTNNNGNNNNT GG |
| S06863-1 | Rps2 | J | 171/172 | GCGGCAGATGGGCGTCTAGAGATATGTGGTATGATATATATATAA ATATATAATATGTAGCCCCGAAATAACTTCACTTGATTTTTATCC CATTCACGAGAGTAGCTAGATTGAAACAACATTGTCCGTTGGCCT AAGTTCAAATAGTCAACCAGAATAAAATGCAGGCTGATCATATCT ATTTTTGATTTTGACTATTTACCAAAACCAATCAAATGGAAGTTG TCTAGCTAGTCTATTCTGGCGCCAAATGGCTTACTTCTCACCTTC TGTTGTATTGGAGTAAGTATGAGGTGCA[G/A]TTCCAAATCTCA TAGAAGTGAGAAAAAAAACATATAAAATGAGTAAAAGATTCATAA ACCTAATCTTTGAAGTTTTGAATTAAAATGTAGTGTTAAATTTCC TTGTGTGATTCATTGGTATAAATCTTTAGTTCAGTGAAATGGGAC CAGGGTTATGATGTTACTGCTCATTTTCTTGACTATTAGCAGATG AGGGATGGTTACAGTGATCAACTCTTTGTTCAGTTACTGGGAAAA GCAGTTTATCAGCTTTGGCAAGACTACAAGGCTAAGTATGGCACC |

TABLE 4-continued

Non-Limiting Examples of Genomic Loci Comprising the Various Marker Loci Provided Herein.*

| Marker Name | Gene/ Locus | LG | Ref. Seq. SEQ ID NO (R/S) | Reference Sequence |
|---|---|---|---|---|
| | | | | AGTTAAGAGGCTATGAGAGCTTTGCATGTTATTTTTTAAAAATAT AAGCGAGTATATATGTCGCAATCTATTTGTATATAGGTTAATTTG TATTAATTCTATGTTTATTCAGCGGAATGGCATGGTCATAGCCTG TT |
| S06864-1 | Rps2 | J | 173/174 | GTACACTTTGCTTAACCAACTCAACTCAACTTTTTAGTGCCTTTA AAAGTAGAAAAAGGAAGTCGTGTTTGAGAGAAAAAGATAAACTTG AAACTGAAGAAAAAGCTAAGAGCTTAACCTCTCTCCTAAAAGCTA ACTAAAACTAACAGAATGTGCACCCTCGCATGTGGCAACCCCACT AAGCTCCTACATGTCAGTTCCCTCCTAACCAACTCCCTGCTCATC AGGGTTGATTTTCTTCTCTTTCAAAGGCTTTCAGCCTTTGTTCTG ACTAAACTAAGCCCAATTTCTATCTGCTAGCCTGGTCTAACAGAA GGGGATATGATWTAACATCGTATTCTCAAAATTGGCACGGATAGA TCCTATTATTTAATCTTAAACTTGTTAAAGGATATAATCTTATAT TCTCAAAATCGGCATGAGGTGGTCCTATTATTTACACTTGAACTT TGTGAAGGACATTTTGATTTGTATCTTTGAACTTTATAATATGA [T/C]TAGTACAGCAGTATGGAATTTGTGAAGATATTTTCTGAGG GCAGACTGTTCAAGGGCATGGTTTTAATTTTTTTATGTATGAACC CCATAGTTTCTGTCCACATCATCATGCCCATGGTCATAGCYKKTT |
| S06865-1 | Rps2 | J | 175/176 | TATCGTACCTGATAAWTGTCAAAAACCTTTCCAACTCCATGGTAT AGACATCAACAGCTTGTTCCAAGACGGTGATTTGTTCCATTTTTC TATCAAATTATACCCAGAGAGAGAAGATAAAGTGTTACAAAAATC CTCCATGTTCTAAAAGACTACCAAAACACCACATCTTCCATGGAA GGAAATTAAAAAGCCTCTCAATCTCTAAAAAATAGAACAAGTC CCATAAACAGCTTGTGAGCTGACACCAAATGGAAGCAAGATGTCC AATTCTGTATCATGATAAAATGATGGGCAAAACTTATATAAGGTT CCATAGGTGCTGTTTGTGCAATTCTCCCATCAAAATTGGAGTTTT AACTTGGCAATTTGCAAGATA[G/A]AAATTTGCATTAAAGGATT ATGCAAATTACCTTGGTGAAACTCCAATTTTGATTGGAGAACGTG TAAACAACACTTGAGGAACTGTAAACAAGTTATTTCCTAAAATAA CCTTCTAGCTCAAATGAGTTCTAAAACATCACTTAACCGAAGCGC CAAATAAAAGAAAACAAGGAACATCTCAACAAGACGACCCTTGTT CTCAGTTCCATGATATGCACACGATTCCATGGTCATAGCYKKKT |
| S11652-1 | Rps2 | J | 177/178 | TCCYYGACATAYTYCCAATAAACTYGTATTCATATGMRYCTCTGT TTCAAACAAACAAAAAGTTCTGATGAAGTCAGCCTAAAATCCTT GCATCCATGTCTTGATAGGTACATTAATTGTCAAGGTTAACAAGA GCATTTCTTTTCTATTTAAATTTKACTAGTTAAATCAATMGACAA GTAAAACCTAATCCAATAAAAACCATAAAGTAAAWTATATTAGTA TGATTGTATACCCATCTTTGAAATGAGAGCCAGACAAGTCAGCTA CTTGTTTCAAAGCCATCCTCCATTCCTGCAGCTTCTCCATCTTAT CTTTGAACCTTTCCTGATGCTTAGTCATTGCTTCTCCATAACTAC CTTTCTGGTGTCTGACATAAGAAGGATC[G/T]ACTTTGTAAAAG ACCGGTATAACCAACAGCCCTTCCCTCTTGCAGTGAAAGATGGTT ACAAGTTCATCTAAACAAAATGAGGAAAAAGCATAGTTTTCAGAA AGCACAATAATAGCAACCCTGGAATCTTGAATTGCCTTCAAAAGT GCAGGTGTTATTTCCTCTCCGCTGTGAAGCTTGTCTTCGTCAAAG AAGGTATGAAATCCCTTGTCACAAAGAGCCTTGTAGAGATWGCCA GTAAAACCATAGCGTGTGTCTGTCCCTCTGA |
| S11682-1 | Rps2 | J | 179/180 | TKGGACCTATCACTTCCAAAGCTAATGGAAGGCCAGAAGCATAAA TWACTACATCATTCAAGACCTCCTTATAACTTGGATCAACCTTTT CGGTTTTAAAAGATTTCCATGTAAGCAATTGAAGAGCATTGTTCT CATTCAATAGTTCCACTTCATATGTTCTTTTAACCCCATGAGATG CTAGCAGTTGTTTGTCCCGAGTGGTGATGATGACTCTACTGCCTG GACCAAACCAACAAGGTCTTCCAACAATAGCCTGTAATTGTTCAT GCTTGTCAACATCATCTAAAATCAAGAGAACCTTCTTTCGCTGAA GCC[G/T]ATGTTGTATAATTGAAGCTCCTTGTTCAACACTTGCT AAGTTGATTTCCTTCTCTCCAAKTATTTCCCGAAGAAGGATGCTC TGGAGGTGTTGTAACCCCTTCTTGTTTGATTTTTCTCTCAAATCT TTAAGAAAACATGAACCATCAAAATGRCAAGCAATCAAATTATAA ACTGCTATAGCAAGTGTTGATTTTCCTATCCCACCAATTCCATGG ATCCCTATCATGTAGACACCAWCATCAGATTCAACATCCAAAAGC TTTGTTACTTCTAGKAATCTTGATTCTAGTCCAACCGGGTAATCC CATGGTCAWAGCYKKTT |
| S09018-1 | Rps3a | F | 181/182 | TTTTTGGTTcaGGTCTGCAACAAAAAAGCCTCTGGGTCAGAGCAC TCATGCTAACACCATACTTGGGACACCAACTGGGCGTCGAATGCT TTCGACGCCTTCTGGCCGCCATGGAAACTCAGGAGGAAAGGACCG TAGAGAAAGTGGCAGAGTGAACAGCATAATTCCAGTGAACTATGT TGCTCTTCCAAAAGATGACTMTGTTTCTAGGGGGAATTAAGGGCT GCCCTCTAATTTGACTC[C/G]TGAATCAGTCAGCTTTGAAAATG |

TABLE 4-continued

Non-Limiting Examples of Genomic Loci Comprising
the Various Marker Loci Provided Herein.*

| Marker Name | Gene/ Locus | LG | Ref. Seq. SEQ ID NO (R/S) | Reference Sequence |
|---|---|---|---|---|
| | | | | CGCTTATTSTACAAGCTCTATTATGTTTCCTTCTGAAACGTTATG CATTGTAAATTTGGTAAATGACAAATGAATGACCCATTCTAGGCT TGATATAGAAGATTGTACAAGTCACGGGCTAAATAGATTACAAAT ATAAAAAGAAGTCATTCTTGTTCTTTCATGTGTGTAAGTTGTCTG ATTTGATTCTTCAAAAATGAGGTGTACTTTAGAGAATAAAGGGTA CTTATAATTAATTTATCAGAAAATTAATAGTTGAGAGTTTGATA AAATTAGATACATATATGRCAATTTAGAKWTRAYRWTYTARWKTW WAW |
| S08342-1 | Rps3a | F | 183/184 | TTAAGTGACTTTAAAATATGACACATTGAAATGACCTGTTTGGAT ATTAAATTTAAAGAATTTTCAAAAATGATGAGAAATTTATTGAA TTTTTTTTTAAAATAAAATAGAATTACAAAACGCTGACAAGGTGT TTTGGTAGGGAGAGATTCTTTTCAATTTCTTAGAAATCTTGGAAG TGTTAAATTCCTATATTTGATATAACTATTTTAATGATCATTTTC ATAAATCTAAAATTCACAAGAATCATTTTTGAATAAGTCTTCTAC TAAACGTGGTTCGGTGGAGAGACTCTACAAAATGAGGTCAGACAT CGTAGGATGTTAGTCAAGCATCGGCCAAACCAGTAAATACTTCAT ATCATATCAATCATATGATGATAAAAAAACGCTTTCTTAAGACAC CGTGAACTCTAGAAAACACATAAAATGAAATCTGCACAAGCTTAA AGCACATGACTAAATAACTTTATCAAAATAAAAAACTAAAATACA GGAAAGTTGAATTGCTTTATCCAAATAAAATTTAAAAAACGAAAG AAGTTTAATTTGCAAATAGCTTGAATTTTTCAAATACCATAC[T/ C][C/A]AAAAATTACCTTGATTTTTCTGGGTCCGGTAA[C/T]G TTCCACGTTGGGCTTAAACTAACTTTGCCATGGAAACTCTGATTG GAGTAACGGAGGATGCACACATCATACCATAGGATAGCGGTAACA CTGTCAGGACACAGCCGAGAGATTTCATTGACAGCAGTGGTGAGA CAGAACTGGCAGAAGTATCCTGTGATGTCGTATCTGCAG |
| S07163-1 | Rps3c | F | 185/186 | GAATTGTAATACGACTCACTATAGGGCGAATTGGGCCCTCTAGAT GCATGCTCGAGCGGCCGCCAGTGTGATGGATATCTGCAGAATTCG CCCTTCAGGAAAGTTGAATTGCTTTATCCAAATAAAATTTAAAAA ACGAAAGAAGTTTAATTTGCAAATAGCTTGAATTTTTCAAATACC ATACTCAAAAATTACCTTGATTTTTCTGGGTCCGGTAA[T/C]GT TCCACGTTGGGCTTAAACTAACTTTGCCATGGAAACTCTGAAGGG CGAATTCCAGCACACTGGCGGCCGTTACTAGTGGATCCGAGCTCG GTACCAAGCTTGGCGTAAT |
| S08442-1 | Rps6 | G | 187/188 | KTKRATTGGCTACTAAAACAAATGCTATATTTGTAAATATATACC AATATAGCAATACAGGGGTAATTGAAAATTCTGATTAACTGTTRA TCTACAGGTTAACAGTCTTCGGCAGGAACTACAACTTCTTGCTAG AGATAGATCAATCACTATTGTAAATGCAAGTGGAACAGGTACTGG TTAGCTACTTTCTTATACACATTATAGGGGCCTTTTGTTATTTCT TCAGCAATTTAATAAATGTTGA[T/C]GTGTTAATTTGCAAACCC ATGATAACTGGTTTTAATTGTGGGCTGTCTCCATACTCTRCACAA GCTAAMCAATGTTTCCTTATTATTTTTACTCCTKTTTTATTTTC TGACTTGTTTGGGAAATGCACAGGTGGGAGAAAATATGCAACAGT GATTGTTATTGTTGTGGTAGGATATGGATACGTTTGGTGGAAGGT AATGYCTTTTCTCTCTCAATTKTTGATTTAAGTAACAGGATGCTG TAGTGATACATTCTTRTTGGAAGCTTTATGGCTAATTTGAATTTR AATATTGGTGCTTWTAACGAGTGCCATCTGCTCTTTGCACAYGGA TACTCTCCACTTAA |
| S08341-1 | Rps6 | G | 189/190 | TTGATGGAAATTCATTTGAAGGGAATATTCCGTCCGAGATTGGAA ATTGTAGCTCTCTTTACTTGCTGTATGCATCCTATTTCTCAAGCT CTAGTGTCATTTCTYTTAACACATCTTTTTGGA[A/T][G/T]AT ATACTAATTCCTATCTATTTTATGCAGGAGTTTGTCTCACAATAA TTTGACTGGTTCAATTCCAAAGTCCATGTCAAAGCTAAACAAGCT CAAAATCCTCAAGCTGGAATTCAATGAACTAAGTGGANANATACC AATGGAGCTTGGAATGCTTCAGAGTCTTCTTGCTGTAAACATATC ATACAACAGGCTCACAGGAAGGCTTCCTACAAGTAGCATATTTCA GAACTTGGACAAAAGTTCCTTGGAAGGAAACCTGGGTCTTTGTTC ACCCTTGTTGAAGGGTCCATGTAANATGAATGTCCCCAAACCACT WGTGCTTGACCCAAATGCCTATAACAACCAAATAAGTCCTCAAAG GCAAACAAACNAATCATCTGAGTCTGGCCCAGTCCATCGCCACAG GTTCCTTAGTGTATCTGCTATTGTAGCAATATCTGCATCCTTTGT CATTGTATTAGGAGTGATTGCTGTTAGCCTACTTAATGTTTCTGT AAGGANAAGCTAACATTTTTGGATAATG |

*The reference sequences for the remaining Rpslk markers are summarized in Table 8.

TABLE 5

Non-limiting Examples of Amplicons Comprising the Various Marker Loci Provided Herein.

| Marker Name | Gene/Locus | LG | Amplicon SEQ ID NO (R/S) | Amplicon Sequence |
|---|---|---|---|---|
| S08291-1 | Rps1a | N | 1303/1304 | GAAAATATGTAAAAGAAGAACTGCCAGATTATATAAA TAAGTTTATCCTTGTCAGTTCATATATATATACACAA TGGAAGATTGTTTAGCAATATTTCTTTGCATTTCTTT TATGTGATAAAAAGTATGTGTAATAATATGGGGGTTG CT[G/A]ATGTGTATGTGAGGTTGTGAAACTTTGTTT TTAAATAAAAATAATTCAAATCTCCTGTTTTGTCTCT CCACGAGGCATTTTT |
| S07292-1 | Rps1c | N | 1305/1306 | CTCCAGCGGGAGATTTGCTTCTTCAAGAAGACTCGTC ATGCTCAAGCTGTTCGGCCCAGCTTGCACATCTTCTC [T/G]ATCAGGTTGGCAATTCAAGTCTAATTGTCCCT TGGCAGCTTCAGCCACCGCATCGTCTGGACTCCTTGA ATCT |
| S08242-1 | Rps1c | N | 1307/1308 | CTTGCATTCTGGAGGTGCTAGTCCCGAATCCAGCAAT TTCCCTG[C/T]GTTTGCACGTAACATAGTTTCTAGT ATTAGTTAAAGGGCAAAACTAAAAAATATGTGCACCA AGAATAGGGGATGG |
| S16592-001 | Rps1d | N | 1344 | CAAACAAACTTGCGTTGCAGATATATTTCAAAACCCT AGCATACRTCTAGCATGGGAGGGGTGCAACCAGTCAC TACAAAAATCATTTGAAAAAATTAATTGCGGATCGGG ACWGATGACAACTGTGCGTACCTTAAAGGGAAYCAGC RAATGAGAGGGTACATATAAAATTGAAGGTGTGAAAC TCCTAGCCTCCAACTGGGATTCTTCCC |
| S07963-2 | Rps1k | N | 1309/1310 | ATGAGGACACAATGCCATGAACCCCAGATCA[T/C]A TATCGCATCTCCTTATAGTATATGTTTCATTTTGTGT CTGCATAGGATTGGCCTTCTCA |
| S07372-1 | Rps1k | N | 1311/1312 | ATTTTGGGCAAATGATGAAGCTAGACTGATAATTGAT TAATTTTGGGCAAATAATATTATATTACATGTATGAG ATTGATTTTAAGTGTATATGCATACATGAAGCAATAG ACTTAATTTAATTA[C/T]CTTAAGGAGTGCTGGACT TTTGAGGATGCCCTTTTGTGCTGATGAGCCCTCCATG GTTGACATACAAAGCAAATTGCAGGGTGTCTTTAGCT GAG |
| S00009-01 | Rps1k | N | 1313/1314 | TGACACGTGGTGCGTTAGGAATTTTGTTTTTAATAAT TTTCCACAYTAAAAAGTGATTTTCATGTGGCT[C/T] AATTTTTTTTAAAAAAAAAATTGAATTAACACTMAT GTGACATTTTTATGTGGAACATGTCAACCTATATAAG TAATAATTTAGAAGTTACCACCTGAACTAATGCGTTT CA |
| S08013-1 | Rps1k | N | 1315/1316 | GAAAACGAAAATTGTAAGAGCAACTTTTAATCATCTT TTCAT[C/T]CAGTGCATGCTTGAAAACTTTGTCAGA AGACAAATTAGTGKAAGCATATATATTAATTTCAATA ATTTATTATGGAATTATCATATGATACCATCCCAAAC TCATTCCAT |
| S06862-1 | Rps2 | J | 1317/1318 | CCAAAGCTGTCTTGGAGGAACTTGAAAAGGTATCTTA CTTCTTTTATTTAAGTAAGTTCTGGCATTCTTGAATT AAATATGTAAGAAAAGTGAAGAGAAGCTTAGTATTAG TTGTTGTTCACAAAATATCAAATTATTTCATTTCCTT TTAAAATTATACTAGCTTGTTG[T/G]TTGCACATGT AAAAGAGTTCATGTTAAAAGCATCTGTTTTG |
| S06863-1 | Rps2 | J | 1319/1320 | TTCTCACCTTCTGTTGTATTGGAGTAAGTATGAGGTG CA[G/A]TTCCAAATCTCATAGAAGTGAGAAAAAAAA CATATAAAATGAGTAAAAGATTCATAAACCTAATCTT TGAAGTTTTGAATTAAAATGTAGTGTTAAATTTCCTT GTGTGA |
| S06864-1 | Rps2 | J | 1321/1322 | TGAACTTTGTGAAGGACATTTTGATTTGTATCTTTGA ACTTTATAATATGA[T/C]TAGTACAGCAGTATGGAA TTTGTGAAGATATTTCTGAGGGCAGACTGTTCAAGG |
| S06865-1 | Rps2 | J | 1323/1324 | TGTGCAATTCTCCCATCAAAATTGGAGTTTTAACTTG GCAATTTGCAAGATA[G/A]AAATTTGCATTAAAGGA TTATGCAAATTACCTTGGTGAAACTCCAATTTTGATT GGAGAACGTGTAAACA |

TABLE 5-continued

Non-limiting Examples of Amplicons Comprising the Various Marker Loci Provided Herein.

| Marker Name | Gene/Locus | LG | Amplicon SEQ ID NO (R/S) | Amplicon Sequence |
|---|---|---|---|---|
| S11652-1 | Rps2 | J | 1325/1326 | ATTCCTGCAGCTTCTCCATCTTATCTTTGAACCTTTC CTGATGCTTAGTCATTGCTTCTCCATAACTACCTTTC TGGTGTCTGACATAAGAAGGATC[G/T]ACTTTGTAA AAGACCGGTATAACCAACAGCCCTTCCCTCTTGCAGT GAAA |
| S11682-1 | Rps2 | J | 1327/1328 | TCATGCTTGTCAACATCATCTAAAATCAAGAGAACCT TCTTTCGCTGAAGCC[G/T]ATGTTGTATAATTGAAG CTCCTTGTTCAACACTTGCTAAGTTGATTTCCTTCTC TCCAAGTATTTCCCGAAGAAGGATGCTCTGGAG |
| S09018-1 | Rps3a | F | 1329/1330 | GACCGTAGAGAAAGTGGCAGAGTGAACAGCATAATTC CAGTGAACTATGTTGCTCTTCCAAAAGATGACTCTGT TTCTAGGGGGAATTAAGGGCTGCCCTCTAATTTGACT C[C/G]TGAATCAGTCAGCTTTGAAAATGCGCTTATT |
| S08342-1 | Rps3a | F | 1331/1332 | AAAGAAGTTTAATTTGCAAATAGCTTGAATTTTTCAA ATACCATAC[T/C][C/A]AAAAATTACCGATTTTTC TGGGTCCGGTAA[C/T]GTTCCACGTTGGGCTTAAAC TAACTTTGCCATGGAAACTCATTGGAGTA |
| S07163-1 | Rps3c | F | 1333/1334 | CAGGAAAGTTGAATTGCTTTATCCAAATAAAATTTAA AAAACGAAAGAAGTTTAATTTGCAAATAGCTTGAATT TTTCAAATACCATACTCAAAAATTACCTTGATTTTTC TGGGTCCGGTAA[T/C]GTTCCACGTTGGGCTTAAAC TAACTTTGCCATGGAAACTCTG |
| S08442-1 | Rps6 | G | 1335/1336 | CACATTATAGGGGCCTTTTGTTATTTCTTCAGCAATT TAATAAATGTTGA[T/C]GTGTTAATTTGCAAACCCA TGATAACTGGTTTTAATTGTGGGCTGTCTCCATACTC TACACAAGCTAAACAATGTTTCCTTATTATTTTTTAC TCCTGTTTTATTTTCTGACTTGTTTGGGAAATGCACA GGTGGGAGAAAATATGCAA |
| S08341-1 | Rps6 | G | 1337/1338 | CGTCCGAGATTGGAAATTGTAGCTCTCTTTACTTGCT GTATGCATCCTATTTCTCAAGCTCTAGTGTCATTTCT YTTAACACATCTTTTTGGA[A/T][G/T]ATATACTA ATTCCTATCTATTTTATGCGGAGTTTGTCTCACA |

In another embodiment, the method of detecting comprises DNA sequencing of at least one of the marker loci provided herein. As used herein, "sequencing" refers to sequencing methods for determining the order of nucleotides in a molecule of DNA. Any DNA sequencing method known in the art can be used in the methods provided herein. Non-limiting examples of DNA sequencing methods useful in the methods provided herein include Next Generation Sequencing (NGS) technologies, for example, as described in Egan, A. N, et al. (2012) *American Journal of Botany* 99(2):175-185; genotyping by sequencing (GBS) methods, for example, as described in Elshire, R. J., et al. (2011) *PLoS ONE* 6(5):e19379; Molecular Inversion Probe (MIP) genotyping, as described, for example, in Hardenbol, P., et al. (2003) *Nature Biotechnology* 21(6):673-678; or high throughput genotyping by whole-genome resequencing, as described, for example in Huang, X et al., (2009) *Genome Research* 19:1068-1076. Each of the above references is incorporated by reference in their entirety herein.

An active variant of any one of SEQ ID NOS: 1-1394 can comprise a polynucleotide having at least 75%, 80% 85%, 90%, 91%, 92%, 93%, 94%, 95%, 96%, 97%, 98% or 99% sequence identity to SEQ ID NOS: 1-1394 as long as it is capable of amplifying and/or detecting the marker locus of interest. By "fragment" is intended a portion of the polynucleotide. A fragment or portion can comprise at least 5, 6, 7, 8, 9, 10, 11, 12, 13, 14, 15, 16, 17, 18, 19, 20, 25, 30, 40, 50, 75, 100, 150, 200, 250, 300, 350, 400 contiguous nucleotides of SEQ ID NOS: 1-1394 as long as it is capable of amplifying and/or detecting the marker locus of interest.

Unless otherwise stated, sequence identity/similarity values provided herein refer to the value obtained using GAP Version 10 using the following parameters: % identity and % similarity for a nucleotide sequence using GAP Weight of 50 and Length Weight of 3, and the nwsgapdna.cmp scoring matrix; or any equivalent program thereof. By "equivalent program" is intended any sequence comparison program that, for any two sequences in question, generates an alignment having identical nucleotide residue matches and an identical percent sequence identity when compared to the corresponding alignment generated by GAP Version 10.

Traits or markers are considered to be linked if they co-segregate. A 1/100 probability of recombination per generation is defined as a map distance of 1.0 centiMorgan (1.0 cM). Genetic elements or genes located on a single chromosome segment are physically linked. Two loci can be located in close proximity such that recombination between homologous chromosome pairs does not occur between the two loci during meiosis with high frequency, e.g., such that linked loci co-segregate at least about 90% of the time, e.g., 91%, 92%, 93%, 94%, 95%, 96%, 97%, 98%, 99%, 99.5%, 99.75%, or more of the time. Genetic elements located within a chromosome segment are also genetically linked, typically within a genetic recombination distance of less than or equal to 50 centimorgans (cM), e.g., about 49, 40, 30, 20, 10, 5, 4, 3, 2, 1, 0.75, 0.5, or 0.25 cM or less. That is, two genetic elements within a single chromosome segment undergo recombination during meiosis with each other at a frequency of less than or equal to about 50%, e.g., about 49%, 40%, 30%, 20%, 10%, 5%, 4%, 3%, 2%, 1%, 0.75%, 0.5%, or 0.25% or less. Closely linked markers display a cross over frequency with a given marker of about 10% or less (the given marker is within about 10 cM of a closely linked marker). In specific embodiments, a closely linked marker is with 10 cM, 9 cM, 8 cM, 7 cM, 6 cM, 5 cM, 4 cM, 3 cM, 2 cM or 1 cM of any given marker disclosed herein. In further embodiments, a marker associated with one of the markers disclosed herein can be within 75 Kb, 60 Kb, 50 Kb, 40 Kb, 30 Kb, 20K, 10 Kb, 5 Kb or less of the disclosed marker. Put another way, closely linked loci co-segregate at least about 90% of the time. Genetic linkage as evaluated by recombination frequency is impacted by the chromatin structure of the region comprising the loci. Typically, the region is assumed to have a euchromatin structure during initial evaluations. However, some regions, such are regions closer to centrosomes, have a heterochromatin structure. Without further information, the predicted physical distance between genetic map positions is based on the assumption that the region is euchromatic, however if the region comprises heterochromatin the markers may be physically closer together. With regard to physical position on a chromosome, closely linked markers can be separated, for example, by about 1 megabase (Mb; 1 million nucleotides), about 500 kilobases (Kb; 1000 nucleotides), about 400 Kb, about 300 Kb, about 200 Kb, about 100 Kb, about 50 Kb, about 25 Kb, about 10 Kb, about 5 Kb, about 2 Kb, about 1 Kb, about 500 nucleotides, about 250 nucleotides, or less.

When referring to the relationship between two genetic elements, such as a genetic element contributing to tolerance and a proximal marker, "coupling" phase linkage indicates the state where the "favorable" allele at the tolerance locus is physically associated on the same chromosome strand as the "favorable" allele of the respective linked marker locus. In coupling phase, both favorable alleles are inherited together by progeny that inherit that chromosome strand. In "repulsion" phase linkage, the "favorable" allele at the locus of interest (e.g., a QTL for tolerance) is physically linked with an "unfavorable" allele at the proximal marker locus, and the two "favorable" alleles are not inherited together (i.e., the two loci are "out of phase" with each other).

Markers are used to define a specific locus on the soybean genome. Each marker is therefore an indicator of a specific segment of DNA, having a unique nucleotide sequence. Map positions provide a measure of the relative positions of particular markers with respect to one another. When a trait is stated to be linked to a given marker it will be understood that the actual DNA segment whose sequence affects the trait generally co-segregates with the marker. More precise and definite localization of a trait can be obtained if markers are identified on both sides of the trait. By measuring the appearance of the marker(s) in progeny of crosses, the existence of the trait can be detected by relatively simple molecular tests without actually evaluating the appearance of the trait itself, which can be difficult and time-consuming because the actual evaluation of the trait requires growing plants to a stage and/or under environmental conditions where the trait can be expressed. Molecular markers have been widely used to determine genetic composition in soybeans.

Favorable genotypes associated with at least trait of interest may be identified by one or more methodologies. In some examples one or more markers are used, including but not limited to AFLPs, RFLPs, ASH, SSRs, SNPs, indels, padlock probes, molecular inversion probes, microarrays, sequencing, and the like. In some methods, a target nucleic acid is amplified prior to hybridization with a probe. In other cases, the target nucleic acid is not amplified prior to hybridization, such as methods using molecular inversion probes (see, for example Hardenbol et al. (2003) Nat Biotech 21:673-678). In some examples, the genotype related to a specific trait is monitored, while in other examples, a genome-wide evaluation including but not limited to one or more of marker panels, library screens, association studies, microarrays, gene chips, expression studies, or sequencing such as whole-genome resequencing and genotyping-by-sequencing (GBS) may be used. In some examples, no target-specific probe is needed, for example by using sequencing technologies, including but not limited to next-generation sequencing methods (see, for example, Metzker (2010) Nat Rev Genet 11:31-46; and, Egan et al. (2012) Am J Bot 99:175-185) such as sequencing by synthesis (e.g., Roche 454 pyrosequencing, Illumina® Genome Analyzer, and Ion Torrent™ PGM or Proton systems), sequencing by ligation (e.g., SOLiD from APPLIED BIOSYSTEMS®, and Polnator system from Azco Biotech), and single molecule sequencing (SMS or third-generation sequencing) which eliminate template amplification (e.g., Helicos system, and PacBio RS system from Pacific BioSciences). Further technologies include optical sequencing systems (e.g., Starlight from Life Technologies), and nanopore sequencing (e.g., GridION from Oxford Nanopore Technologies). Each of these may be coupled with one or more enrichment strategies for organellar or nuclear genomes in order to reduce the complexity of the genome under investigation via PCR, hybridization, restriction enzyme (see, e.g., Elshire et al. (2011) PLoS ONE 6:e19379), and expression methods. In some examples, no reference genome sequence is needed in order to complete the analysis.

The use of marker assisted selection (MAS) to select a soybean plant or germplasm which has a certain marker locus, haplotype or marker profile is provided. For instance, in certain examples a soybean plant or germplasm possessing a certain predetermined favorable marker locus or haplotype will be selected via MAS. In certain other examples, a soybean plant or germplasm possessing a certain predetermined favorable marker profile will be selected via MAS.

Using MAS, soybean plants or germplasm can be selected for markers or marker alleles that positively correlate with *Phytophthora* tolerance, without actually raising soybean and measuring for tolerance (or, contrawise, soybean plants can be selected against if they possess markers that negatively correlate with tolerance). MAS is a powerful tool to select for desired phenotypes and for introgressing desired traits into cultivars of soybean (e.g., introgressing desired traits into elite lines). MAS is easily adapted to high throughput molecular analysis methods that can quickly screen large numbers of plant or germplasm genetic material for the markers of interest and is much more cost effective than raising and observing plants for visible traits.

In some embodiments, the molecular markers or marker loci are detected using a suitable amplification-based detection method. In these types of methods, nucleic acid primers are typically hybridized to the conserved regions flanking the polymorphic marker region. In certain methods, nucleic acid probes that bind to the amplified region are also employed. In general, synthetic methods for making oligonucleotides, including primers and probes, are well known in the art. For example, oligonucleotides can be synthesized chemically according to the solid phase phosphoramidite triester method described by Beaucage and Caruthers (1981) Tetrahedron Letts 22:1859-1862, e.g., using a commercially available automated synthesizer, e.g., as described in Needham-VanDevanter, et al. (1984) Nucleic Acids Res. 12:6159-6168. Oligonucleotides, including modified oligonucleotides, can also be ordered from a variety of commercial sources known to persons of skill in the art.

It will be appreciated that suitable primers and probes to be used can be designed using any suitable method. It is not intended that the invention be limited to any particular primer, primer pair or probe. For example, primers can be designed using any suitable software program, such as LASERGENE® or Primer3.

It is not intended that the primers be limited to generating an amplicon of any particular size. For example, the primers used to amplify the marker loci and alleles herein are not limited to amplifying the entire region of the relevant locus. In some embodiments, marker amplification produces an amplicon at least 20 nucleotides in length, or alternatively, at least 50 nucleotides in length, or alternatively, at least 100 nucleotides in length, or alternatively, at least 200 nucleotides in length.

Non-limiting examples of polynucleotide primers useful for detecting the marker loci provided herein are provided in Table 2 and include, for example, SEQ ID NOS: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 1339, 1340 or variants or fragments thereof.

PCR, RT-PCR, and LCR are in particularly broad use as amplification and amplification-detection methods for amplifying nucleic acids of interest (e.g., those comprising marker loci), facilitating detection of the markers. Details regarding the use of these and other amplification methods are well known in the art and can be found in any of a variety of standard texts. Details for these techniques can also be found in numerous journal and patent references, such as Mullis, et al. (1987) U.S. Pat. No. 4,683,202; Arnheim & Levinson (Oct. 1, 1990) C&EN 36-47; Kwoh, et al. (1989) Proc. Natl. Acad. Sci. USA 86:1173; Guatelli, et al., (1990) Proc. Natl. Acad. Sci. USA87:1874; Lomell, et al., (1989) J. Clin. Chem. 35:1826; Landegren, et al., (1988) Science 241:1077-1080; Van Brunt, (1990) Biotechnology 8:291-294; Wu and Wallace, (1989) Gene 4:560; Barringer, et al., (1990) Gene 89:117, and Sooknanan and Malek, (1995) Biotechnology 13:563-564.

Such nucleic acid amplification techniques can be applied to amplify and/or detect nucleic acids of interest, such as nucleic acids comprising marker loci. Amplification primers for amplifying useful marker loci and suitable probes to detect useful marker loci or to genotype SNP alleles are provided. For example, exemplary primers and probes are provided in SEQ ID NOS: 1-154, 1339-1342 and in Tables 2 and 3, and the genomic loci comprising the various marker loci provided herein are provided in SEQ ID NOS: 155-1302, 1343, 1345-1394 and in Table 4. Non-limiting examples of amplicon sequences comprising the marker loci provided herein are provided in SEQ ID NOS: 1303-1338, 1344 and in Table 5. However, one of skill will immediately recognize that other primer and probe sequences could also be used. For instance primers to either side of the given primers can be used in place of the given primers, so long as the primers can amplify a region that includes the allele to be detected, as can primers and probes directed to other SNP marker loci. Further, it will be appreciated that the precise probe to be used for detection can vary, e.g., any probe that can identify the region of a marker amplicon to be detected can be substituted for those examples provided herein. Further, the configuration of the amplification primers and detection probes can, of course, vary. Thus, the compositions and methods are not limited to the primers and probes specifically recited herein.

In certain examples, probes will possess a detectable label. Any suitable label can be used with a probe. Detectable labels suitable for use with nucleic acid probes include, for example, any composition detectable by spectroscopic, radioisotopic, photochemical, biochemical, immunochemical, electrical, optical, or chemical means. Useful labels include biotin for staining with labeled streptavidin conjugate, magnetic beads, fluorescent dyes, radiolabels, enzymes, and colorimetric labels. Other labels include ligands, which bind to antibodies labeled with fluorophores, chemiluminescent agents, and enzymes. A probe can also constitute radiolabelled PCR primers that are used to generate a radiolabelled amplicon. Labeling strategies for labeling nucleic acids and corresponding detection strategies can be found, e.g., in Haugland (1996) *Handbook of Fluorescent Probes and Research Chemicals Sixth Edition* by Molecular Probes, Inc. (Eugene Oreg.); or Haugland (2001) *Handbook of Fluorescent Probes and Research Chemicals Eighth Edition* by Molecular Probes, Inc. (Eugene Oreg.).

Detectable labels may also include reporter-quencher pairs, such as are employed in Molecular Beacon and TaqMan™ probes. The reporter may be a fluorescent organic dye modified with a suitable linking group for attachment to the oligonucleotide, such as to the terminal 3' carbon or terminal 5' carbon. The quencher may also be an organic dye, which may or may not be fluorescent, depending on the embodiment. Generally, whether the quencher is fluorescent or simply releases the transferred energy from the reporter by non-radiative decay, the absorption band of the quencher should at least substantially overlap the fluorescent emission band of the reporter to optimize the quenching. Non-fluorescent quenchers or dark quenchers typically function by absorbing energy from excited reporters, but do not release the energy radiatively.

Selection of appropriate reporter-quencher pairs for particular probes may be undertaken in accordance with known techniques. Fluorescent and dark quenchers and their relevant optical properties from which exemplary reporter-quencher pairs may be selected are listed and described, for example, in Berlman, *Handbook of Fluorescence Spectra of Aromatic Molecules,* 2nd ed., Academic Press, New York, 1971, the content of which is incorporated herein by reference. Examples of modifying reporters and quenchers for covalent attachment via common reactive groups that can be added to an oligonucleotide in the present invention may be found, for example, in Haugland, *Handbook of Fluorescent Probes and Research Chemicals*, Molecular Probes of Eugene, Oreg., 1992, the content of which is incorporated herein by reference.

In certain examples, reporter-quencher pairs are selected from xanthene dyes including fluoresceins and rhodamine dyes. Many suitable forms of these compounds are available commercially with substituents on the phenyl groups, which can be used as the site for bonding or as the bonding functionality for attachment to an oligonucleotide. Another useful group of fluorescent compounds for use as reporters are the naphthylamines, having an amino group in the alpha or beta position. Included among such naphthylamino compounds are 1-dimethylaminonaphthyl-5 sulfonate, 1-anilino-8-naphthalene sulfonate and 2-p-touidinyl-6-naphthalene sulfonate. Other dyes include 3-phenyl-7-isocyanatocoumarin; acridines such as 9-isothiocyanatoacridine; N-(p-(2-benzoxazolyl)phenyl)maleimide; benzoxadiazoles; stilbenes; pyrenes and the like. In certain other examples, the reporters and quenchers are selected from fluorescein and rhodamine dyes. These dyes and appropriate linking methodologies for attachment to oligonucleotides are well known in the art.

Suitable examples of reporters may be selected from dyes such as SYBR green, 5-carboxyfluorescein (5-FAM™ available from Applied Biosystems of Foster City, Calif.), 6-carboxyfluorescein (6-FAM), tetrachloro-6-carboxyfluorescein (TET), 2,7-dimethoxy-4,5-dichloro-6-carboxyfluorescein, hexachloro-6-carboxyfluorescein (HEX), 6-carboxy-2',4,7,7'-tetrachlorofluorescein (6-TET™ available from Applied Biosystems), carboxy-X-rhodamine (ROX), 6-carboxy-4',5'-dichloro-2',7'-dimethoxyfluorescein (6-JOE™ available from Applied Biosystems), VIC™ dye products available from Molecular Probes, Inc., NED™ dye products available from Applied Biosystems, and the like. Suitable examples of quenchers may be selected from 6-carboxy-tetramethyl-rhodamine, 4-(4-dimethylaminophenylazo) benzoic acid (DABYL), tetramethylrhodamine (TAMRA), BHQ-0™, BHQ-1™, BHQ-2™, and BHQ-3™, each of which are available from Biosearch Technologies, Inc. of Novato, Calif., QSY-7™, QSY-9™, QSY-21™ and QSY-35™, each of which are available from Molecular Probes, Inc., and the like.

In one aspect, real time PCR or LCR is performed on the amplification mixtures described herein, e.g., using molecular beacons or TaqMan™ probes. A molecular beacon (MB) is an oligonucleotide which, under appropriate hybridization conditions, self-hybridizes to form a stem and loop structure. The MB has a label and a quencher at the termini of the oligonucleotide; thus, under conditions that permit intra-molecular hybridization, the label is typically quenched (or at least altered in its fluorescence) by the quencher. Under conditions where the MB does not display intra-molecular hybridization (e.g., when bound to a target nucleic acid, such as to a region of an amplicon during amplification), the MB label is unquenched. Details regarding standard methods of making and using MBs are well established in the literature and MBs are available from a number of commercial reagent sources. See also, e.g., Leone, et al., (1995) Molecular beacon probes combined with amplification by NASBA enable homogenous real-time detection of RNA, Nucleic Acids Res. 26:2150-2155; Tyagi and Kramer, (1996) Molecular beacons: probes that fluoresce upon hybridization, Nature Biotechnology 14:303-308; Blok and Kramer, (1997) Amplifiable hybridization probes containing a molecular switch, Mol Cell Probes 11:187-194; Hsuih. et al., (1997) Novel, ligation-dependent PCR assay for detection of hepatitis C in serum, J Clin Microbiol 34:501-507; Kostrikis, et al., (1998) Molecular beacons: spectral genotyping of human alleles, Science 279:1228-1229; Sokol, et al., (1998) Real time detection of DNA:RNA hybridization in living cells, Proc. Natl. Acad. Sci. U.S.A. 95:11538-11543; Tyagi, et al., (1998) Multicolor molecular beacons for allele discrimination, Nature Biotechnology 16:49-53; Bonnet, et al., (1999) Thermodynamic basis of the chemical specificity of structured DNA probes, Proc. Natl. Acad. Sci. U.S.A. 96:6171-6176; Fang, et al. (1999) Designing a novel molecular beacon for surface-immobilized DNA hybridization studies, J. Am. Chem. Soc. 121:2921-2922; Marras, et al., (1999) Multiplex detection of single-nucleotide variation using molecular beacons, Genet. Anal. Biomol. Eng. 14:151-156; and Vet, et al., (1999) Multiplex detection of four pathogenic retroviruses using molecular beacons, Proc. Natl. Acad. Sci. U.S.A. 96:6394-6399. Additional details regarding MB construction and use is found in the patent literature, e.g., U.S. Pat. Nos. 5,925,517; 6,150,097; and 6,037,130.

Another real-time detection method is the 5'-exonuclease detection method, also called the TaqMan™ assay, as set forth in U.S. Pat. Nos. 5,804,375; 5,538,848; 5,487,972; and 5,210,015, each of which is hereby incorporated by reference in its entirety. In the TaqMan™ assay, a modified probe, typically 10-25 nucleic acids in length, is employed during PCR which binds intermediate to or between the two members of the amplification primer pair. The modified probe possesses a reporter and a quencher and is designed to generate a detectable signal to indicate that it has hybridized with the target nucleic acid sequence during PCR. As long as both the reporter and the quencher are on the probe, the quencher stops the reporter from emitting a detectable signal. However, as the polymerase extends the primer during amplification, the intrinsic 5' to 3' nuclease activity of the polymerase degrades the probe, separating the reporter from the quencher, and enabling the detectable signal to be emitted. Generally, the amount of detectable signal generated during the amplification cycle is proportional to the amount of product generated in each cycle.

It is well known that the efficiency of quenching is a strong function of the proximity of the reporter and the quencher, i.e., as the two molecules get closer, the quenching efficiency increases. As quenching is strongly dependent on the physical proximity of the reporter and quencher, the reporter and the quencher are preferably attached to the probe within a few nucleotides of one another, usually within 30 nucleotides of one another, more preferably with a separation of from about 6 to 16 nucleotides. Typically, this separation is achieved by attaching one member of a reporter-quencher pair to the 5' end of the probe and the other member to a nucleotide about 6 to 16 nucleotides away, in some cases at the 3' end of the probe.

Separate detection probes can also be omitted in amplification/detection methods, e.g., by performing a real time amplification reaction that detects product formation by modification of the relevant amplification primer upon incorporation into a product, incorporation of labeled nucleotides into an amplicon, or by monitoring changes in molecular rotation properties of amplicons as compared to unamplified precursors (e.g., by fluorescence polarization).

Further, it will be appreciated that amplification is not a requirement for marker detection—for example, one can directly detect unamplified genomic DNA simply by performing a Southern blot on a sample of genomic DNA. Procedures for performing Southern blotting, amplification e.g., (PCR, LCR, or the like), and many other nucleic acid detection methods are well established and are taught, e.g., in Sambrook, et al., *Molecular Cloning—A Laboratory Manual* (3d ed.), Vol. 1-3, Cold Spring Harbor Laboratory, Cold Spring Harbor, N.Y., 2000 ("Sambrook"); *Current Protocols in Molecular Biology*, F. M. Ausubel, et al., eds., Current Protocols, a joint venture between Greene Publishing Associates, Inc. and John Wiley & Sons, Inc., (supplemented through 2002) ("Ausubel")) and *PCR Protocols A Guide to Methods and Applications* (Innis, et al., eds) Academic Press Inc. San Diego, Calif. (1990) (Innis). Additional details regarding detection of nucleic acids in plants can also be found, e.g., in *Plant Molecular Biology* (1993) Croy (ed.) BIOS Scientific Publishers, Inc.

Other techniques for detecting SNPs can also be employed, such as allele specific hybridization (ASH). ASH technology is based on the stable annealing of a short, single-stranded, oligonucleotide probe to a completely complementary single-stranded target nucleic acid. Detection is via an isotopic or non-isotopic label attached to the probe. For each polymorphism, two or more different ASH probes are designed to have identical DNA sequences except at the polymorphic nucleotides. Each probe will have exact homology with one allele sequence so that the range of probes can distinguish all the known alternative allele sequences. Each probe is hybridized to the target DNA. With appropriate probe design and hybridization conditions, a single-base mismatch between the probe and target DNA will prevent hybridization.

Real-time amplification assays, including MB or TaqMan™ based assays, are especially useful for detecting SNP alleles. In such cases, probes are typically designed to bind to the amplicon region that includes the SNP locus, with one allele-specific probe being designed for each possible SNP allele. For instance, if there are two known SNP alleles for a particular SNP locus, "A" or "C," then one probe is designed with an "A" at the SNP position, while a separate probe is designed with a "C" at the SNP position. While the probes are typically identical to one another other than at the SNP position, they need not be. For instance, the two allele-specific probes could be shifted upstream or downstream relative to one another by one or more bases. However, if the probes are not otherwise identical, they should be designed such that they bind with approximately equal efficiencies, which can be accomplished by designing under a strict set of parameters that restrict the chemical properties of the probes. Further, a different detectable label, for instance a different reporter-quencher pair, is typically employed on each different allele-specific probe to permit differential detection of each probe. In certain examples, each allele-specific probe for a certain SNP locus is 11-20 nucleotides in length, dual-labeled with a florescence quencher at the 3' end and either the 6-FAM (6-carboxyfluorescein) or VIC (4,7,2'-trichloro-7'-phenyl-6-carboxyfluorescein) fluorophore at the 5' end.

To effectuate SNP allele detection, a real-time PCR reaction can be performed using primers that amplify the region including the SNP locus, for instance the sequences listed in Table 4, the reaction being performed in the presence of all allele-specific probes for the given SNP locus. By then detecting signal for each detectable label employed and determining which detectable label(s) demonstrated an increased signal, a determination can be made of which allele-specific probe(s) bound to the amplicon and, thus, which SNP allele(s) the amplicon possessed. For instance, when 6-FAM- and VIC-labeled probes are employed, the distinct emission wavelengths of 6-FAM (518 nm) and VIC (554 nm) can be captured. A sample that is homozygous for one allele will have fluorescence from only the respective 6-FAM or VIC fluorophore, while a sample that is heterozygous at the analyzed locus will have both 6-FAM and VIC fluorescence.

The KASPar® and Illumina® Detection Systems are additional examples of commercially-available marker detection systems. KASPar® is a homogeneous fluorescent genotyping system which utilizes allele specific hybridization and a unique form of allele specific PCR (primer extension) in order to identify genetic markers (e.g. a particular SNP locus associated with *Phytophthora* tolerance). Illumina® detection systems utilize similar technology in a fixed platform format. The fixed platform utilizes a physical plate that can be created with up to 384 markers. The Illumina® system is created with a single set of markers that cannot be changed and utilizes dyes to indicate marker detection.

These systems and methods represent a wide variety of available detection methods which can be utilized to detect markers associated with tolerance or improved tolerance to *Phytophthora*, but any other suitable method could also be used.

Introgression of *Phytophthora* tolerance into non-tolerant or less-tolerant soybean germplasm is provided. Any method for introgressing one or more marker loci into soybean plants known to one of skill in the art can be used. Typically, a first soybean germplasm that contains *Phytophthora* tolerance derived from a particular marker locus, haplotype or marker profile and a second soybean germplasm that lacks such tolerance derived from the marker locus, haplotype or marker profile are provided. The first soybean germplasm may be crossed with the second soybean germplasm to provide progeny soybean germplasm. These progeny germplasm are screened to determine the presence of *Phytophthora* tolerance derived from the marker locus, haplotype or marker profile, and progeny that tests positive for the presence of tolerance derived from the marker locus, haplotype or marker profile are selected as being soybean germplasm into which the marker locus, haplotype or marker profile has been introgressed. Methods for performing such screening are well known in the art and any suitable method can be used.

One application of MAS is to use the tolerance markers, haplotypes or marker profiles to increase the efficiency of an introgression or backcrossing effort aimed at introducing a tolerance trait into a desired (typically high yielding) background. In marker assisted backcrossing of specific markers from a donor source, e.g., to an elite genetic background, one selects among backcross progeny for the donor trait and then uses repeated backcrossing to the elite line to reconstitute as much of the elite background's genome as possible.

Thus, the markers and methods can be utilized to guide marker assisted selection or breeding of soybean varieties with the desired complement (set) of allelic forms of chromosome segments associated with superior agronomic performance (tolerance, along with any other available markers for yield, disease tolerance, etc.). Any of the disclosed marker loci, marker alleles, haplotypes, or marker profiles can be introduced into a soybean line via introgression, by traditional breeding (or introduced via transformation, or both) to yield a soybean plant with superior agronomic performance. The number of alleles associated with tolerance that can be introduced or be present in a soybean plant ranges from 1 to the number of alleles disclosed herein, each integer of which is incorporated herein as if explicitly recited.

The markers and methods provided herein can also be utilized to guide marker assisted selection or breeding of soybean varieties comprising other *Phytophthora* tolerance markers or alleles to create a molecular stack for *Phytophthora* tolerance. Any of the marker loci provided herein can be introduced into a soybean line having one or more of the *Phytophthora* tolerance alleles rps1, rps2, rps3, rps4, rps5, rps6, rps7 or rps8. For example, the stacked combinations can include Rps1c and Rps3; Rps1k and Rps6; Rps1k and Rps3; Rps1c, Rps1k and Rps3; or Rps1c, Rps1k and Rps6. Rps1c, Rps1k and Rps6; Rps1c and Rps1k; or any combination of one or more of Rps1a, Rps1b, Rps1c, Rps1d, Rps1k, Rps2, Rps3a, Rps3b, Rps3c, Rps4, Rps5, Rps6, Rps7, Rps8 and Rps Yu25. The Rps loci are described, for example, in Sugimoto, Takuma, et al. "Pathogenic diversity of *Phytophthora sojae* and breeding strategies to develop *Phytophthora*-resistant soybeans." *Breeding Science* 61.5 (2012): 511-522; Sun, S., et al. 2011. Characterization and mapping of RpsYu25, a novel resistance gene to *Phytophthora sojae*. *Plant Breed.* 30:139-143; and Gordon, S. G., et al. 2007. Molecular marker analysis of soybean plant introductions with resistance to *Phytophthora sojae*. *Phytopathology* 97:113-118; each of which is herein incorporated by reference in their entirety.

In one embodiment, any one or more of the marker loci provided herein can be stacked with the rps1 allele. In another embodiment, any one or more of the marker loci provided herein can be stacked with the rps2 allele. In another embodiment, any one or more of the marker loci provided herein can be stacked with the rps3 allele. In yet another embodiment, any one or more of the marker loci provided herein can be stacked with the rps6 allele.

This also provides a method of making a progeny soybean plant and these progeny soybean plants, per se. The method comprises crossing a first parent soybean plant with a second soybean plant and growing the female soybean plant under plant growth conditions to yield soybean plant progeny. Methods of crossing and growing soybean plants are well within the ability of those of ordinary skill in the art. Such soybean plant progeny can be assayed for alleles associated with tolerance and, thereby, the desired progeny selected. Such progeny plants or seed can be sold commercially for soybean production, used for food, processed to obtain a desired constituent of the soybean, or further utilized in subsequent rounds of breeding. At least one of the first or second soybean plants is a soybean plant in that it comprises at least one of the marker loci or marker profiles, such that the progeny are capable of inheriting the marker locus or marker profile.

Often, a method is applied to at least one related soybean plant such as from progenitor or descendant lines in the subject soybean plants pedigree such that inheritance of the desired tolerance can be traced. The number of generations separating the soybean plants being subject to the methods provided herein will generally be from 1 to 20, commonly 1 to 5, and typically 1, 2, or 3 generations of separation, and quite often a direct descendant or parent of the soybean plant will be subject to the method (i.e., 1 generation of separation).

Genetic diversity is important for long term genetic gain in any breeding program. With limited diversity, genetic gain will eventually plateau when all of the favorable alleles have been fixed within the elite population. One objective is to incorporate diversity into an elite pool without losing the genetic gain that has already been made and with the minimum possible investment. MAS provides an indication of which genomic regions and which favorable alleles from the original ancestors have been selected for and conserved over time, facilitating efforts to incorporate favorable variation from exotic germplasm sources (parents that are unrelated to the elite gene pool) in the hopes of finding favorable alleles that do not currently exist in the elite gene pool.

For example, the markers, haplotypes, primers, probes, and marker profiles can be used for MAS in crosses involving elite x exotic soybean lines by subjecting the segregating progeny to MAS to maintain major yield alleles, along with the tolerance marker alleles herein.

As an alternative to standard breeding methods of introducing traits of interest into soybean (e.g., introgression), transgenic approaches can also be used to create transgenic plants with the desired traits. In these methods, exogenous nucleic acids that encode a desired marker loci, marker profile or haplotype are introduced into target plants or germplasm. For example, a nucleic acid that codes for a tolerance trait is cloned, e.g., via positional cloning, and introduced into a target plant or germplasm.

Experienced plant breeders can recognize tolerant soybean plants in the field, and can select the tolerant individuals or populations for breeding purposes or for propagation. In this context, the plant breeder recognizes "tolerant" and "non-tolerant" or "susceptible" soybean plants. However, plant tolerance is a phenotypic spectrum consisting of extremes in tolerance and susceptibility, as well as a continuum of intermediate tolerance phenotypes. Evaluation of these intermediate phenotypes using reproducible assays are of value to scientists who seek to identify genetic loci that impart tolerance, to conduct marker assisted selection for tolerant populations, and to use introgression techniques to breed a tolerance trait into an elite soybean line, for example.

By "improved tolerance" is intended that the plants show a decrease in the disease symptoms that are the outcome of plant exposure to *Phytophthora*. That is, the damage caused by *Phytophthora* infection is prevented, or alternatively, the disease symptoms caused by *Phytophthora* infection is minimized or lessened. Thus, improved tolerance to *Phytophthora* can result in reduction of the disease symptoms by at least about 2% to at least about 6%, at least about 5% to about 50%, at least about 10% to about 60%, at least about 30% to about 70%, at least about 40% to about 80%, or at least about 50% to about 90% or greater. Hence, the methods provided herein can be utilized to protect plants from *Phytophthora* infection.

Screening and selection of *Phytophthora* tolerant soybean plants may be performed, for example, by exposing plants to *Phytophthora* and selecting those plants showing tolerance to *Phytophthora*. Various assays can be used to measure tolerance or improved tolerance to *Phytophthora*. For example, *Phytophthora* tolerance can be determined by visual observations after plant exposure to a particular race of *Phytophthora*.

Non-limiting examples of *Phytophthora* tolerance phenotypic screening are described in detail below.

PHYTOPHTHORA FIELD TOLERANCE. Tolerance to *Phytophthora* root rot is rated on a scale of 1 to 9, with a score of 1 indicating the plants have no tolerance to *Phytophthora*, ranging to a score of 9 being the best or highest tolerance. PRTLAB indicates the tolerance was scored using plants in lab assay experiments. Preliminary scores are reported as double digits, for example '55' indicates a preliminary score of 5 on the scale of 1 to 9.

PHYTOPHTHORA RESISTANCE GENE (Rps). Various *Phytophthora* resistance genes are known and include but are not limited to: Rps1-a=resistance to races 1-2, 10-11, 13-8, 24; Rps1-c=resistance to races 1-3, 6-11, 13, 15, 17, 21, 23, 24, 26, 28-30, 32, 34, 36; Rps1-k=resistance to races 1-11, 13-15, 17, 18, 21-24, 26, 36, 37; Rps3-a=resistance to races 1-5, 8, 9, 11, 13, 14, 16, 18, 23, 25, 28, 29, 31-35, 39-41, 43-45, 47-52, 54; Rps3-c=resistance to races 1-4, 10-16, 18-36, 38-54; Rps6=resistance to races 1-4, 10, 12, 14-16, 18-21, 25, 28, 33-35; and, Rps8=resistance to races 1-5, 9, 13-15, 21, 25, 29, 32.

RESISTANCE. As used herein, resistance is synonymous with tolerance and is used to describe the ability of a plant to withstand exposure to an insect, disease, herbicide, environmental stress, or other condition. A resistant plant variety will be able to better withstand the insect, disease pathogen, herbicide, environmental stress, or other condition as compared to a non-resistant or wild-type variety.

Genes that confer resistance to *Phytophthora* Root Rot, such as Rps1, Rps1-a, Rps1-b, Rps1-c, Rps1-d, Rps1-e, Rps1-k, Rps2, Rps3-a, Rps3-b, Rps3-c, Rps4, Rps5, Rps6, Rps7, Rps8, and other Rps genes. See, for example, Shoemaker et al. "*Phytophthora* Root Rot Resistance Gene Mapping in Soybean", Plant Genome IV Conference, San Diego, Calif. (1995).

*Phytophthora sojae* is maintained by refrigeration on agar. It is transferred to fresh agar plates to make inoculum for the test.

Test and check lines are grown in growth chambers under controlled light and controlled temperature conditions. The lines are inoculated at the seedling stage by injecting mycelium into the hypocotyl. The unclassified lines are incubated in conditions conducive for *Phytophthora* infection, and then evaluated when the known susceptible controls die. The plants can be inoculated with at least one of: *Phytophthora* race 4 (PMG04); *Phytophthora* race 7 (PMG07); and/or *Phytophthora* race 25 (PMG25). Experiments are scored 2-3 days following inoculation, depending on the reaction of susceptible and resistant checks. Infection phenotypes are classified based on the number of seedlings alive divided by the total number of seedlings inoculated. For example,
9=9 of 9 plants alive and healthy
5=5 of 9 plants alive and healthy
1=1 or 0 of 9 plants alive and healthy
M=no or poor germ (<5 seeds germinate)

The level of tolerance of soybean varieties to *Phytophthora* Root Rot can be evaluated and characterized in the field. *Phytophthora* Root Rot is well known to those skilled in the art (see, e.g., Schmitthenner and Walker, Tolerance versus resistance for control of *Phytophthora* root rot of soybeans. p. 35-44 In H. D. Loden and D. Wilkenson (ed.) Proceedings of the 9$^{th}$ Soybean Seed Research Conference, Chicago, Ill. 13-14 Dec. 1979. American Seed Trade Association, Washington, D.C.; Walker and Schmitthenner (1984) Crop Science 24:487-489; and, Schmitthenner and Bhat. 1994. Useful methods for studying *Phytophthora* in the laboratory. Department of Plant Pathology. Ohio Agricultural Research and Development Center. Circular 143).

For testing, seed samples from experimental and check lines are not treated with any seed treatment. A known set of differential checks is used. One or more races of *Phytophthora* are chosen. Normally, at least Race 25 *Phytophthora sojae* is used. Experimental lines and checks are sown in vermiculite in trays that are inoculated with mycelium. The trays are moved outside to a location covered with 30% sunlight block netting.

Differential checks with low tolerance show symptoms 1-2 weeks after planting. Experimental lines are scored approximately three weeks after planting by removing the plants and root mass intact from the vermiculite. The vermiculite is removed by tapping the roots, without damaging the roots. All experimental entries are scored relative to the appearance of the root system of one or more check variety (s) and the known performance chart score of each check. Scores are assigned on a scale of 1-9, and are relative to the differential checks and based upon total root mass, general appearance of plants and roots, and extent of necrosis.
1=all plants die after emerging
2=50% less root mass than 9306
3=equal to 9306
4=50% less root mass than Conrad, 25% more than 9306
5=25% less root mass than Conrad
6=equal to Conrad
7=equal to 92B38 and/or 93B67
8=equal to 93B45
9=equal to 9242

In some examples, a kit or an automated system for detecting marker loci, haplotypes, and marker profiles, and/or correlating the marker loci, haplotypes, and marker profiles with a desired phenotype (e.g., *Phytophthora* tolerance) are provided. As used herein, "kit" refers to a set of reagents for the purpose of performing the various methods of detecting or identifying herein, more particularly, the identification and/or the detection of a soybean plant or germplasm having tolerance or improved tolerance to *Phytophthora*.

In one embodiment, a kit for detecting or selecting at least one soybean plant or soybean germplasm with tolerance or improved tolerance to *Phytophthora* infection is provided. Such a kit comprises (a) primers or probes for detecting one or more marker loci associated with tolerance to *Phytophthora* infection, wherein at least one of the primers and probes in the kit are capable of detecting a marker locus, wherein the marker locus is: (i) associated with the Rps1a, Rsp1c, Rps1d or Rps1k loci on linkage group N; (ii) associated with Rps2 locus on linkage group J; (iii) associated with the Rps3a or Rps3c loci on linkage group F; or (iv) associated with the Rps6 locus on linkage group G; and (b) instructions for using the primers or probes for detecting the one or more marker loci and correlating the detected marker loci with predicted tolerance to *Phytophthora* infection.

In a specific embodiment, the primers and probes of the kit are capable of detecting a marker locus comprising: (a) S08291-1, S07292-1, S08242-1, S16592-001 or a marker closely linked thereto on linkage group N; (b) S07963-2, S07372-1, S00009-01, S08013-1, the Rps1k marker loci in Table 1B or a marker closely linked thereto on linkage group N, such as, for example, the markers provided in FIG. 1A-C; (c) S06862-1, S06863-1, S06864-1, S06865-1, S11652-1, S11682-1 or a marker closely linked thereto on linkage group J, such as, for example, the markers provided in FIG. 3 A-C; (d) S09018-1, S08342-1, S07163-1 or a marker closely linked thereto on linkage group F, such as, for example, those markers provided in FIG. 2 A-D; or (e) S08442-1, 508341-1 or a marker closely linked thereto on linkage group G, such as, for example, the markers provided in FIG. 4 A-E.

Thus, a typical kit or system can include a set of marker probes or primers configured to detect at least one favorable allele of one or more marker loci associated with tolerance to *Phytophthora* infection, for instance a favorable marker locus, haplotype or marker profile. These probes or primers can be configured, for example, to detect the marker loci noted in the tables and examples herein, e.g., using any available allele detection format, such as solid or liquid phase array based detection, microfluidic-based sample detection, etc. The systems and kits can further include packaging materials for packaging the probes, primers, or instructions, controls such as control amplification reactions that include probes, primers or template nucleic acids for amplifications, molecular size markers, or the like.

A typical system can also include a detector that is configured to detect one or more signal outputs from the set of marker probes or primers, or amplicon thereof, thereby identifying the presence or absence of the allele. A wide variety of signal detection apparatus are available, including photo multiplier tubes, spectrophotometers, CCD arrays, scanning detectors, phototubes and photodiodes, microscope stations, galvo-scans, microfluidic nucleic acid amplification detection appliances and the like. The precise configuration of the detector will depend, in part, on the type of label used to detect the marker allele, as well as the instrumentation that is most conveniently obtained for the user. Detectors that detect fluorescence, phosphorescence, radioactivity, pH, charge, absorbance, luminescence, temperature, magnetism or the like can be used. Typical detector examples include light (e.g., fluorescence) detectors or radioactivity detectors. For example, detection of a light emission (e.g., a fluorescence emission) or other probe label is indicative of the presence or absence of a marker allele. Fluorescent detection is generally used for detection of amplified nucleic acids (however, upstream and/or downstream operations can also be performed on amplicons, which can involve other detection methods). In general, the detector detects one or more label (e.g., light) emission from a probe label, which is indicative of the presence or absence of a marker allele. The detector(s) optionally monitors one or a plurality of signals from an amplification reaction. For example, the detector can monitor optical signals which correspond to "real time" amplification assay results.

System or kit instructions that describe how to use the system or kit or that correlate the presence or absence of the favorable allele with the predicted tolerance are also provided. For example, the instructions can include at least one look-up table that includes a correlation between the presence or absence of the favorable alleles, haplotypes, or marker profiles and the predicted tolerance. The precise form of the instructions can vary depending on the components of the system, e.g., they can be present as system software in one or more integrated unit of the system (e.g., a microprocessor, computer or computer readable medium), or can be present in one or more units (e.g., computers or computer readable media) operably coupled to the detector. As noted, in one typical example, the system instructions include at least one look-up table that includes a correlation between the presence or absence of the favorable alleles and predicted tolerance. The instructions also typically include instructions providing a user interface with the system, e.g., to permit a user to view results of a sample analysis and to input parameters into the system.

Isolated polynucleotides comprising the nucleic acid sequences of the primers and probes provided herein are also encompassed herein. In one embodiment, the isolated polynucleotide comprises a polynucleotide capable of detecting a marker locus of the soybean genome comprising (a) S08291-1, S07292-1, S08242-1, S16592-001 or a marker closely linked thereto on linkage group N; (b) S07963-2, S07372-1, S00009-01, 508013-1, any of the Rps1k marker loci in Table 1B or a marker closely linked thereto on linkage group N; (c) S06862-1, S06863-1, S06864-1, S06865-1, S11652-1, S11682-1 or a marker closely linked thereto on linkage group J; (d) S09018-1, S08342-1, S07163-1 or a marker closely linked thereto on linkage group F; or (e) S08442-1, S08341-1 or a marker closely linked thereto on linkage group G.

In specific embodiments, the isolated polynucleotide comprises: (a) a polynucleotide comprising SEQ ID NOS: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 1339 or 1340; (b) a polynucleotide comprising SEQ ID NOs: 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 1341 or 1342; (c) a polynucleotide having at least 90% sequence identity to SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 1339, 1340, 1341 or 1342; or (d) a polynucleotide comprising at least 10 contiguous nucleotides of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 1339, 1340, 1341 or 1342.

In certain embodiments, the isolated nucleic acids are capable of hybridizing under stringent conditions to nucleic acids of a soybean cultivar tolerant to *Phytophthora*, for instance to particular SNPs that comprise a marker locus, haplotype or marker profile.

As used herein, a substantially identical or complementary sequence is a polynucleotide that will specifically hybridize to the complement of the nucleic acid molecule to which it is being compared under high stringency conditions. A polynucleotide is said to be the "complement" of another polynucleotide if they exhibit complementarity. As used herein, molecules are said to exhibit "complete complementarity" when every nucleotide of one of the polynucleotide molecules is complementary to a nucleotide of the other. Two molecules are said to be "minimally complementary" if they can hybridize to one another with sufficient stability to permit them to remain annealed to one another under at least conventional "low-stringency" conditions. Similarly, the molecules are said to be "complementary" if they can hybridize to one another with sufficient stability to permit them to remain annealed to one another under conventional "high-stringency" conditions.

Appropriate stringency conditions which promote DNA hybridization, for example, 6× sodium chloride/sodium citrate (SSC) at about 45° C., followed by a wash of 2×SSC at 50° C., are known to those skilled in the art or can be found in *Current Protocols in Molecular Biology*, John Wiley & Sons, N.Y. (1989), 6.3.1-6.3.6. Typically, stringent conditions for hybridization and detection will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1.0 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C. Optionally, wash buffers may comprise about 0.1% to about 1% SDS. Duration of hybridization is generally less than about 24 hours, usually about 4 to about 12 hours. The duration of the wash time will be at least a length of time sufficient to reach equilibrium.

Non-limiting examples of methods and compositions disclosed herein are as follows:

1. A method of identifying a first soybean plant or a first soybean germplasm that displays tolerance or improved tolerance to *Phytophthora* infection, the method comprising detecting in the genome of said first soybean plant or in the genome of said first soybean germplasm at least one marker locus that is associated with the tolerance, wherein:
   (a) the at least one marker locus comprises S08291-1, S07292-1, S08242-1, S16592-001 or a marker closely linked thereto on linkage group N;
   (b) the at least one marker locus comprises S07963-2, S07372-1, S00009-01, S08013-1, any of the Rps1k marker loci in Table 1B or a marker closely linked thereto on linkage group N;
   (c) the at least one marker locus comprises S06862-1, S06863-1, S06864-1, S06865-1, S11652-1, S11682-1 or a marker closely linked thereto on linkage group J;
   (d) the at least one marker locus comprises S09018-1, S08342-1, S07163-1 or a marker closely linked thereto on linkage group F; or
   (e) the at least one marker locus comprises S08442-1, S08341-1 or a marker closely linked thereto on linkage group G.

2. The method of embodiment 1, wherein at least two marker loci are detected.

3. The method of embodiment 2, wherein the at least two marker loci comprise a haplotype that is associated with said tolerance.

4. The method of embodiment 2, wherein the at least two marker loci comprise a marker profile that is associated with said tolerance.

5. The method of any one of embodiments 1-4, wherein the germplasm is a soybean variety.

6. The method of any one of embodiments 1-5, wherein the method further comprises selecting the first soybean plant or first soybean germplasm or a progeny thereof having the at least one marker locus.

7. The method of embodiment 6, further comprising crossing the selected first soybean plant or first soybean germplasm with a second soybean plant or second soybean germplasm.

8. The method of embodiment 7, wherein the second soybean plant or second soybean germplasm comprises an exotic soybean strain or an elite soybean strain.

9. The method of any one of embodiments 1-8, wherein the detecting comprises DNA sequencing of at least one of said marker loci.

10. The method of any one of embodiments 1-8, wherein the detecting comprises amplifying at least one of said marker loci and detecting the resulting amplified marker amplicon.

11. The method of embodiment 10, wherein the amplifying comprises:
   a) admixing an amplification primer or amplification primer pair for each marker locus being amplified with a nucleic acid isolated from the first soybean plant or the first soybean germplasm, wherein the primer or primer pair is complementary or partially complementary to a variant or fragment of the genomic locus comprising the marker locus, and is capable of initiating DNA polymerization by a DNA polymerase using the soybean nucleic acid as a template; and
   b) extending the primer or primer pair in a DNA polymerization reaction comprising a DNA polymerase and a template nucleic acid to generate at least one amplicon.

12. The method of embodiment 11, wherein said method comprises amplifying a variant or fragment of one or more polynucleotides comprising SEQ ID NOs:155, 156, 157, 158, 159, 160, 161, 162, 163, 164, 165, 166, 167, 168, 191-1302, 1343, 1345, 1346, 1347, 1348, 1349, 1350, 1351, 1352, 1353, 1354, 1355, 1356, 1357, 1358, 1359, 1360, 1361, 1362, 1363, 1364, 1365, 1366, 1367, 1368, 1369, 1370, 1371, 1372, 1373, 1374, 1375, 1376, 1377, 1378, 1379, 1380, 1381, 1382, 1383, 1384, 1385, 1386, 1387, 1388, 1389, 1390, 1391, 1392, 1393 or 1394.

13. The method of embodiment 11, wherein said primer or primer pair comprises a variant or fragment of one or more polynucleotides comprising SEQ ID NOs: 155, 156, 157, 158, 159, 160, 161, 162, 163, 164, 165, 166, 167, 168, 191-1302, 1343, 1345, 1346, 1347, 1348, 1349, 1350, 1351, 1352, 1353, 1354, 1355, 1356, 1357, 1358, 1359, 1360, 1361, 1362, 1363, 1364, 1365, 1366, 1367, 1368, 1369, 1370, 1371, 1372, 1373, 1374, 1375, 1376, 1377, 1378, 1379, 1380, 1381, 1382, 1383, 1384, 1385, 1386, 1387, 1388, 1389, 1390, 1391, 1392, 1393 or 1394 or complements thereof.

14. The method of embodiment 13, wherein said primer or primer pair comprises a nucleic acid sequence comprising SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 1339, 1340 or variants or fragments thereof 15. The method of embodiment 14, wherein said primer pair comprises:
   a) SEQ ID NO: 1 and SEQ ID NO:2;
   b) SEQ ID NO: 9 and SEQ ID NO:10;
   c) SEQ ID NO: 20 and SEQ ID NO:21;
   d) SEQ ID NO: 22 and SEQ ID NO: 23;
   e) SEQ ID NO: 24 and SEQ ID NO: 25;
   f) SEQ ID NO: 36 and SEQ ID NO: 37;
   g) SEQ ID NO: 38 and SEQ ID NO: 39; or
   h) SEQ ID NO: 1339 and SEQ ID NO: 1340.

16. The method of embodiment 11, wherein said method comprises amplifying a variant or fragment of SEQ ID NOs: 173, 174, 175, 176, 177, 178, 179 or 180.

17. The method of embodiment 11, wherein said primer or primer pair comprises a variant or fragment of SEQ ID NOs: 173, 174, 175, 176, 177, 178, 179, 180 or complements thereof 18. The method of embodiment 17, wherein said primer or primer pair comprises a nucleic acid sequence comprising SEQ ID NOs: 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78 or variants or fragments thereof.

19. The method of embodiment 18, wherein said primer pair comprises:
   a) SEQ ID NO: 40 and SEQ ID NO: 41;
   b) SEQ ID NO: 46 and SEQ ID NO: 47;
   c) SEQ ID NO: 52 and SEQ ID NO: 53;

d) SEQ ID NO: 58 and SEQ ID NO: 59;
e) SEQ ID NO: 64 and SEQ ID NO: 65; or
f) SEQ ID NO: 75 and SEQ ID NO: 76.

20. The method of embodiment 11, wherein said method comprises amplifying a variant or fragment of SEQ ID NOs: 181, 182, 183, 184, 185 or 186.

21. The method of embodiment 11, wherein said primer or primer pair comprises a variant or fragment of SEQ ID NOs: 181, 182, 183, 184, 185, 186 or complements thereof 22. The method of embodiment 21, wherein said primer or primer pair comprises a nucleic acid sequence comprising SEQ ID NOs: 79, 80, 81, 82, 83, 84, 85, 86, 87, 88, 89, 90, 91, 92 or variants or fragments thereof 23. The method of embodiment 22, wherein said primer pair comprises:
   a) SEQ ID NO: 81 and SEQ ID NO: 82;
   b) SEQ ID NO: 89 and SEQ ID NO: 90; or
   c) SEQ ID NO: 91 and SEQ ID NO: 92.

24. The method of embodiment 11, wherein said method comprises amplifying a variant or fragment of SEQ ID NOs: 187, 188, 189 or 190.

25. The method of embodiment 11, wherein said primer or primer pair comprises a variant or fragment of SEQ ID NOs: 187, 188, 189, 190 or complements thereof.

26. The method of embodiment 25, wherein said primer or primer pair comprises a nucleic acid sequence comprising SEQ ID NOs: 93, 94, 95, 96, 97, 98, 99, 100, 101, 102, 103, 104 or variants or fragments thereof 27. The method of embodiment 26, wherein said primer pair comprises:
   a) SEQ ID NO: 95 and SEQ ID NO: 96; or
   b) SEQ ID NO: 101 and SEQ ID NO: 102.

28. The method of embodiment 11, wherein the method further comprises providing one or more labeled nucleic acid probes suitable for detection of each marker locus being amplified.

29. The method of embodiment 28, wherein said labeled nucleic acid probe comprises a nucleic acid sequence comprising a variant or fragment of one or more polynucleotides comprising SEQ ID NOs: 155, 156, 157, 158, 159, 160, 161, 162, 163, 164, 165, 166, 167, 168, 191-1302, 1343, 1345, 1346, 1347, 1348, 1349, 1350, 1351, 1352, 1353, 1354, 1355, 1356, 1357, 1358, 1359, 1360, 1361, 1362, 1363, 1364, 1365, 1366, 1367, 1368, 1369, 1370, 1371, 1372, 1373, 1374, 1375, 1376, 1377, 1378, 1379, 1380, 1381, 1382, 1383, 1384, 1385, 1386, 1387, 1388, 1389, 1390, 1391, 1392, 1393 or 1394 or complements thereof 30. The method of embodiment 29, wherein the labeled nucleic acid probe comprises a nucleic acid sequence comprising SEQ ID NOs: 105, 106, 107, 108, 109, 110, 112, 113, 114, 115, 116, 117, 118, 119, 120, 121, 122, 123, 124, 125, 126, 127, 1341 or 1342.

31. The method of embodiment 28, wherein said labeled nucleic acid probe comprises a nucleic acid sequence comprising a variant or fragment of SEQ ID NOs: 173, 174, 175, 176, 177, 178, 179, 180 or complements thereof.

32. The method of embodiment 31, wherein the labeled nucleic acid probe comprises a nucleic acid sequence comprising SEQ ID NOs: 128, 129, 130, 131, 132, 133, 134, 135, 136, 137, 138 or 139.

33. The method of embodiment 28, wherein said labeled nucleic acid probe comprises a nucleic acid sequence comprising a variant or fragment of SEQ ID NOs: 181, 182, 183, 184, 185, 186 or complements thereof.

34. The method of embodiment 33, wherein the labeled nucleic acid probe comprises a nucleic acid sequence comprising SEQ ID NOs: 140, 141, 142, 143, 144, 145, 146, 147, 148 or 149.

35. The method of embodiment 28, wherein said labeled nucleic acid probe comprises a nucleic acid sequence comprising a variant or fragment of SEQ ID NOs: 187, 188, 189, 190 or complements thereof.

36. The method of embodiment 35, wherein the labeled nucleic acid probe comprises a nucleic acid sequence comprising SEQ ID NOs: 150, 151, 152, 153 or 154.

37. An isolated polynucleotide capable of detecting a marker locus of the soybean genome comprising S08291-1, S07292-1, S08242-1, S16592-001, S07963-2, S07372-1, S00009-01, S08013-1, any of the Rps1k marker loci in Table 1B or a marker closely linked thereto on linkage group N.

38. The isolated polynucleotide of embodiment 37, wherein the polynucleotide comprises:
   (a) a polynucleotide comprising SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 1339 or 1340;
   (b) a polynucleotide comprising SEQ ID NOs: 105, 106, 107, 108, 109, 110, 111, 112, 113, 114, 115, 116, 117, 118, 119, 120, 121, 122, 123, 124, 125, 126, 127, 1341 or 1342;
   (c) a polynucleotide having at least 90% sequence identity to the polynucleotides set forth in parts (a) or (b); or
   (d) a polynucleotide comprising at least 10 contiguous nucleotides of the polynucleotides set forth in parts (a) or (b).

39. An isolated polynucleotide capable of detecting a marker locus of the soybean genome comprising S06862-1, S06863-1, S06864-1, S06865-1, S11652-1, S11682-1 or a marker closely linked thereto on linkage group J.

40. The isolated polynucleotide of embodiment 39, wherein the polynucleotide comprises:
   (a) a polynucleotide comprising SEQ ID NOs: 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77 or 78;
   (b) a polynucleotide comprising SEQ ID NOs: 128, 129, 130, 131, 132, 133, 134, 135, 136, 137, 138 or 139;
   (c) a polynucleotide having at least 90% sequence identity to the polynucleotides set forth in parts (a) or (b); or
   (d) a polynucleotide comprising at least 10 contiguous nucleotides of the polynucleotides set forth in parts (a) or (b).

41. An isolated polynucleotide capable of detecting a marker locus of the soybean genome comprising S09018-1, S08342-1, S07163-1 or a marker closely linked thereto on linkage group F.

42. The isolated polynucleotide of embodiment 41, wherein the polynucleotide comprises:
   (a) a polynucleotide comprising SEQ ID NOs: 79, 80, 81, 82, 83, 84, 85, 86, 87, 88, 89, 90, 91 or 92;
   (b) a polynucleotide comprising SEQ ID NOs: 140, 141, 142, 143, 144, 145, 146, 147, 148 or 149;
   (c) a polynucleotide having at least 90% sequence identity to the polynucleotides set forth in parts (a) or (b); or
   (d) a polynucleotide comprising at least 10 contiguous nucleotides of the polynucleotides set forth in parts (a) or (b).

43. An isolated polynucleotide capable of detecting a marker locus of the soybean genome comprising S08442-1, S08341-1 or a marker closely linked thereto on linkage group G.

44. The isolated polynucleotide of embodiment 43, wherein the polynucleotide comprises:
   (a) a polynucleotide comprising SEQ ID NOs: 93, 94, 95, 96, 97, 98, 99, 100, 101, 102, 103 or 104;
   (b) a polynucleotide comprising SEQ ID NOs: 150, 151, 152, 153 or 154;
   (c) a polynucleotide having at least 90% sequence identity to the polynucleotides set forth in parts (a) or (b); or
   (d) a polynucleotide comprising at least 10 contiguous nucleotides of the polynucleotides set forth in parts (a) or (b).

45. A kit for detecting or selecting at least one soybean plant or soybean germplasm with tolerance or improved tolerance to *Phytophthora* infection, the kit comprising:
   (a) primers or probes for detecting one or more marker loci associated with tolerance to *Phytophthora* infection, wherein the primers or probes are capable of detecting a marker locus, wherein:
      (i) the at least one marker locus comprises S08291-1, 507292-1, S08242-1, S16592-001 or a marker closely linked thereto on linkage group N;
      (ii) the at least one marker locus comprises S07963-2, S07372-1, S00009-01, S08013-1, any of the Rps1k marker loci in Table 1B or a marker closely linked thereto on linkage group N;
      (iii) the at least one marker locus comprises S06862-1, S06863-1, S06864-1, S06865-1, S11652-1, S11682-1 or a marker closely linked thereto on linkage group J;
      (iv) the at least one marker locus comprises S09018-1, S08342-1, 507163-1 or a marker closely linked thereto on linkage group F; or
      (v) the at least one marker locus comprises S08442-1, S08341-1 or a marker closely linked thereto on linkage group G.
   (b) instructions for using the primers or probes for detecting the one or more marker loci and correlating the detected marker loci with predicted tolerance to *Phytophthora* infection.

EXPERIMENTAL

The following examples are offered to illustrate, but not to limit the claimed invention. It is understood that the examples and embodiments described herein are for illustrative purposes only, and persons skilled in the art will recognize various reagents or parameters that can be altered without departing from the spirit of the invention or the scope of the appended claims.

Example 1

Marker Loci Associated with *Phytophthora* Tolerance at Rps1 Loci

Markers were developed to characterize, identify, and/or select resistant or susceptible alleles at the Rps1 locus on linkage group N (ch 3). Markers were screened against various known resistant and susceptible parents.

A. Rps1a

A marker to locus S08291-1 was developed to identify alleles associated with the *phytophthora* resistance phenotype, this marker detects a G/A polymorphism associated with Rps1a. A panel of lines used for development for markers to identify Rps1c included lines with Rps1k and Rps1a, and provided information for alleles in the Rps1a genomic region. During development, this marker was validated and confirmed against a panel of about 30 resistant and susceptible varieties which included proprietary experimental lines, proprietary commercial lines, and public lines. Further development and testing was done to optimize the marker system for high throughput analysis of soybean. From this testing, S08291-1-Q5 was chosen for high throughput analysis needs, but other versions can be used to detect the polymorphism. This marker was used to fingerprint about 2000 lines.

Genomic DNA was extracted for testing using a standard CTAB protocol and exemplary amplification conditions are described below.

| 94° C. | 2 min | 1 cycle |
|--------|-------|---------|
| 94° C. | 30 sec | 40 cycles |
| 60° C. | 60 sec | |

| | |
|---|---|
| H2O | 3.625 |
| hottub buffer | 0.5 |
| dNTP (2.5 mM each) | 0.375 |
| primer1 + primer2 (10 uM each) | 0.15 |
| primer3 + primer4 (10 uM each) | 0.15 |
| probe 1 (10 uM) | 0.05 |
| Probe 2 (10 uM) | 0.05 |
| hottub enzyme | 0.025 |
| Invitrogen rox dye (50X) | 0.075 |
| DNA | 0.05 |
| Total | 5.05 |

B. Rps1c

Several populations were developed in order to identify and characterize *Phytophthora* resistance loci and polymorphisms for marker development. The following biparental crosses were made and phenotyped for the *Phytophthora* races (PMG Race) indicated, as shown in Table 6.

TABLE 6

| Parent 1 | Parent 2 | Gene | Entries | PMG Race(s) |
|----------|----------|------|---------|-------------|
| 92M61 | 93Y13 | Deletion/Rps1c | 120 | 7 |
| 91Y20 | 93Y13 | Rps1k/Rps1c | 92 | 7 & 4 |
| 93M42 | XB18S09 | Rps1a/Rps1c | 92 | 7 & 1 |
| 92M61 | XB18S09 | Deletion/Rps1c | 92 | 7 |

Markers to the S07292-1 locus and the S08242 locus were developed to identify alleles associated with the *Phytophthora* resistance phenotype associated with Rps1c. During development, these markers were validated and confirmed against a panel of about 30 varieties which included proprietary experimental lines, proprietary commercial lines, and public lines. Further development and testing was done to optimize each marker system for high throughput analysis of soybean.

C. Rps1d

Rps1d was mapped near Rps1k and may be an alternate allele of the Rps1 locus (Sugimoto et al., 2008. Identification of SSR markers linked to the *Phytophthora* resistance gene Rps1-d in soybean (2008) *Plant Breeding*, 127 (2): 154-159). SNPs that could be used for marker assisted selection of Rps1d were identified near the Rps1k region through sequencing of amplicons generated using extracted DNA from EX23U07, a progeny of the Rps1d donor PI103091. EX23U07 has the minor allele at SNP, 516592-001, which was found to be at low allele frequency across a diverse set of germplasm (~6.2%, see table below). The Taqman assay 516592-001-Q001 was designed to assay this SNP and will be useful for MAS of Rps1d.

TABLE 7

The following lines were genotyped using the Taqman marker S16592-001-Q001. Column three indicates the predicted allele at the Rps1 locus within the respective line based on phenotypic screens of *phytophthora* resistance.

| Sample Name | S16592-001 | Trait |
|---|---|---|
| EX23U07 | A | Rps1d |
| ARKSOY | A | Rps1c |
| Ralsoy | A | Rps1c |
| 91Y41 | A | Rps1c |
| 91Y92 | A | Rps1c |
| 92M81 | A | Rps1c |
| 93M14 | A | Rps1c |
| 93Y80 | A | Rps1c |
| ARKSOY | A | Rps1c |
| Ralsoy | A | Rps1c |
| Sheyenne | A | . |
| 92B38 | T | None |
| 92M33 | T | None |
| 92M61 | T | None |
| 92Y70 | T | None |
| 93Y23 | T | None |
| 93Y30 | T | None |
| 93Y70 | T | None |
| 93Y72 | T | None |
| 93Y92 | T | None |
| 94M80 | T | None |
| 94Y50 | T | None |
| 94Y70 | T | None |
| 94Y80 | T | None |
| 94Y90 | T | None |
| 95M50 | T | None |
| 95Y01 | T | None |
| 95Y20 | T | None |
| 95Y30 | T | None |
| 95Y31 | T | None |
| 90M01 | T | Rps1k |
| 90M02 | T | Rps1k |
| 90M91 | T | Rps1k |
| 90M92 | T | Rps1k |
| 90Y21 | T | Rps1k |
| 90Y41 | T | Rps1k |
| 90Y42 | T | Rps1k |
| 90Y50 | T | Rps1k |
| 90Y70 | T | Rps1k |
| 91B42 | T | Rps1k |
| 91M01 | T | Rps1k |
| 91M13 | T | Rps1k |
| 91M30 | T | Rps1k |
| 91M41 | T | Rps1k |
| 91M51 | T | Rps1k |
| 91M61 | T | Rps1k |
| 91Y20 | T | Rps1k |
| 91Y21 | T | Rps1k |
| 91Y70 | T | Rps1k |
| 91Y72 | T | Rps1k |
| 91Y80 | T | Rps1k |
| 92B12 | T | Rps1k |
| 92M02 | T | Rps1k |
| 92M11 | T | Rps1k |
| 92M21 | T | Rps1k |
| 92M72 | T | Rps1k |
| 92M76 | T | Rps1k |
| 92M91 | T | Rps1k |
| 92Y10 | T | Rps1k |
| 92Y20 | T | Rps1k |
| 92Y21 | T | Rps1k |
| 92Y30 | T | Rps1k |
| 92Y51 | T | Rps1k |
| 92Y52 | T | Rps1k |
| 92Y54 | T | Rps1k |
| 92Y60 | T | Rps1k |
| 92Y61 | T | Rps1k |
| 92Y72 | T | Rps1k |
| 92Y80 | T | Rps1k |
| 92Y82 | T | Rps1k |
| 92Y90 | T | Rps1k |
| 92Y91 | T | Rps1k |
| 93B82 | T | Rps1k |
| 93B86 | T | Rps1k |
| 93M11 | T | Rps1k |
| 93M82 | T | Rps1k |
| 93M92 | T | Rps1k |
| 93M96 | T | Rps1k |
| 93Y02 | T | Rps1k |
| 93Y04 | T | Rps1k |
| 93Y05 | T | Rps1k |
| 93Y10 | T | Rps1k |
| 93Y11 | T | Rps1k |
| 93Y15 | T | Rps1k |
| 93Y20 | T | Rps1k |
| 93Y21 | T | Rps1k |
| 93Y40 | T | Rps1k |
| 93Y50 | T | Rps1k |
| 93Y51 | T | Rps1k |
| 93Y60 | T | Rps1k |
| 93Y81 | T | Rps1k |
| 93Y90 | T | Rps1k |
| 93Y91 | T | Rps1k |
| 93Y93 | T | Rps1k |
| 94B73 | T | Rps1k |
| 94M30 | T | Rps1k |
| 94Y01 | T | Rps1k |
| 94Y10 | T | Rps1k |
| 94Y20 | T | Rps1k |
| 94Y30 | T | Rps1k |
| 94Y40 | T | Rps1k |
| 94Y60 | T | Rps1k |
| 94Y91 | T | Rps1k |
| 95Y40 | T | Rps1k |
| 93M42 | T | 1A |
| 93Y82 | T | 1A |
| 95Y10 | T | 1A |
| KINGWA | T | Rps1k |
| 9071 | T | Rps1c |
| 9181 | T | Rps1c |
| 900Y71 | T | Rps1c |
| 90B43 | T | Rps1c |
| 90B51 | T | Rps1c |
| 90M60 | T | Rps1c |
| 90M80 | T | Rps1c |
| 90Y90 | T | Rps1c |
| 94Y21 | T | Rps1c |
| A1564 | T | . |
| A2943 | T | . |
| A3127 | T | . |
| A3733 | T | . |
| A4715 | T | . |
| A5979 | T | . |
| A6297 | T | . |
| ADAMS | T | . |
| BAVENDERSPECIALA | T | . |
| BLACKHAWK | T | . |
| Capital | T | . |
| CLARK | T | . |
| CLARK63 | T | . |
| CNS | T | . |
| DORMAN | T | . |
| Dunfield | T | . |
| ESSEX | T | . |
| FC31745 | T | . |
| FOWLER | T | . |
| Haberlandt | T | . |
| HAROSOY | T | . |
| HAWKEYE | T | . |
| Illini | T | . |

TABLE 7-continued

The following lines were genotyped using the Taqman marker S16592-001-Q001. Column three indicates the predicted allele at the Rps1 locus within the respective line based on phenotypic screens of *phytophthora* resistance.

| Sample Name | S16592-001 | Trait |
|---|---|---|
| JACKSON | T | . |
| Kanro | T | . |
| KS3406 | T | . |
| L15 | T | . |
| LEE | T | . |
| Lincoln | T | . |
| LP14575198 | T | . |
| MT95-123720 | T | . |
| Mukden | T | . |
| OGDEN | T | . |
| P2981 | T | . |
| Palmetto | T | . |
| Patoka | T | . |
| Peking | T | . |
| PERRY | T | . |
| PI084674 | T | . |
| PI171442 | T | . |
| PI180501 | T | . |
| PI248404 | T | . |
| PI391589 | T | . |
| PI424195B | T | . |
| PI437151 | T | . |
| PI54610 | T | . |
| PI605891B | T | . |
| PI81041 | T | . |
| PI84946-2 | T | . |
| PI88788 | T | . |
| PI91110-1 | T | . |
| Pintado | T | . |
| Richland | T | . |
| S-100 | T | . |
| SENECA | T | . |
| ST2250 | T | . |
| ST2660 | T | . |
| Tokyo | T | . |
| WAYNE | T | . |
| Williams | T | . |

D. Rps1k

Markers to loci S00009-1, S07963-2, and S08013 were developed in order to characterize and identify lines having a Rps1k resistance allele. It was observed that over time marker S00009-01-A did not always identify lines known to have Rps1k. It was hypothesized that this could be due to a recombination event in the region. A new target region was selected near the Rps1k locus and sequenced. Markers S07963-2-Q1 and S08013-1Q were designed based on the SNP profile of the sequenced region. These markers were tested on a panel of public and proprietary lines which included known Rps1k lines, susceptible lines, and other test lines. The allele and haplotype data are summarized below in Table 8.

TABLE 8

| Phenotype | # lines | S00009-01-A | S07963-2-Q1 | S08013-1-Q1 |
|---|---|---|---|---|
| 1k | 5 | C | T | C |
| SUS | 17 | T | C | T |
| 1k + 3a | | C | T | C |
| 1k | 1 | — | — | — |
| 1k + unknown | 1 | C | T | C |
| Unknown | 5 | T | C | T |
| 1k | 1 | T | T | C |
| SUS | 3 | C | C | T |

Markers S07963-2-Q1 and S08013-1Q were further evaluated and validated against four F3 mapping populations using the following amplification conditions.

| 94° C. | 10 min | 1 cycle |
|---|---|---|
| 94° C. | 30 sec | 40 cycles |
| 60° C. | 60 sec | 40 cycles |

| DNA (dried down) | 16 ng |
|---|---|
| Water | 2.42 |
| KlearKall Mastermix | 2.5 |
| Forward Primer (100 μm) | 0.0375 |
| Reverse Primer (100 μm) | 0.0375 |
| Probe 1 (100 μm) | 0.005 |
| Probe 2 (100 μm) | 0.005 |
| Total | 5 |

Case Control Association Analysis

Using a case-control association analysis, the Rps1k locus which conditions variation in *phytophthora* root rot resistance, was fine-mapped between 3915646-4533559 by on Gm03 (Lg N). A set of 581 SNPs were identified in this region that perfectly differentiate resistant from susceptible lines. These markers are ideal candidates for marker-assisted selection of resistance to *phytophthora* root rot from the Rps1k locus.

Phenotypic data from lab screening for *Phytophthora* resistance was used in the study. DNA was prepped using standard Illumina TruSeq Chemistry. Selected resistant and susceptible lines formed the case groups and were sequenced to ~0.5-40× genome coverage on an Illumina HiSeq2000. SNPs were called using a proprietary software to automate the process, missing data was imputed using a separate proprietary software. Haploview was used to conduct a case-control association analysis on a set of 15537 SNPs identified in the region from 34000026-5085535 by on Gm03. The case group comprised 57 proprietary soybean lines resistant to *phytophthora* and the control group comprised 9 proprietary susceptible lines. Following Haploview filtering using the settings noted below, 7491 SNPs remained in the analysis. Nine SNPs had all missing values in the control group and were removed from additional analysis.

Haploview Settings:
  Do Association Test
  Case/Control Data
  Ignore Pairwise comparisons of markers >10 kb apart
  Exclude individuals with >50% missing genotypes
  HW p-value cutoff: 0.0
  Min genotype % 50
  Max # mendel errors: 1
  Minimum minor allele freq. 0.05

The presence of haplotypes were also observed in a panel of lines not included in the association study.

A plot of chi square values from case-control analysis versus physical position of 7482 SNPs reveals a peak of SNP to trait association between 3915646-4533559 by on Gm03, suggesting that a locus conditioning *phytophthora* resistance is in this region. A total of 581 SNPs have a perfect association between 9 susceptible (control) and 57 resistant (case) lines (Table 9). These markers are ideal for TaqMan™ assay design or for evaluation by other methods, including sequencing, hybridization, or other technologies. Numerous additional SNPs analyzed here that are linked to region but are not in perfect LD with trait could be very informative markers when used in select germplasm.

TABLE 9

| Name | Assoc Allele | Case, Control Ratio Counts | Case, Control Frequencies | Chi Square | P-value | Ref. Sequence SEQ ID NO (Res.) | Ref. Sequence SEQ ID NO (Sus.) |
|---|---|---|---|---|---|---|---|
| Gm03:3915646 | A | 112:0, 0:8 | 1.000, 0.000 | 120 | 6.33E−28 | 1345 | 1346 |
| Gm03:3917778 | A | 114:0, 0:14 | 1.000, 0.000 | 128 | 1.12E−29 | 191 | 747 |
| Gm03:3918853 | T | 114:0, 0:14 | 1.000, 0.000 | 128 | 1.12E−29 | 192 | 748 |
| Gm03:3920367 | A | 114:0, 0:18 | 1.000, 0.000 | 132 | 1.50E−30 | 193 | 749 |
| Gm03:3926721 | T | 114:0, 0:18 | 1.000, 0.000 | 132 | 1.50E−30 | 194 | 750 |
| Gm03:3926775 | A | 114:0, 0:18 | 1.000, 0.000 | 132 | 1.50E−30 | 195 | 751 |
| Gm03:3927474 | T | 114:0, 0:16 | 1.000, 0.000 | 130 | 4.10E−30 | 196 | 752 |
| Gm03:3927724 | G | 114:0, 0:18 | 1.000, 0.000 | 132 | 1.50E−30 | 197 | 753 |
| Gm03:3929330 | A | 114:0, 0:14 | 1.000, 0.000 | 128 | 1.12E−29 | 198 | 754 |
| Gm03:3929383 | A | 114:0, 0:14 | 1.000, 0.000 | 128 | 1.12E−29 | 199 | 755 |
| Gm03:3930408 | A | 114:0, 0:14 | 1.000, 0.000 | 128 | 1.12E−29 | 200 | 756 |
| Gm03:3930551 | T | 114:0, 0:12 | 1.000, 0.000 | 126 | 3.07E−29 | 201 | 757 |
| Gm03:3930806 | T | 114:0, 0:14 | 1.000, 0.000 | 128 | 1.12E−29 | 202 | 758 |
| Gm03:3932629 | T | 114:0, 0:14 | 1.000, 0.000 | 128 | 1.12E−29 | 203 | 759 |
| Gm03:3932974 | T | 114:0, 0:16 | 1.000, 0.000 | 130 | 4.10E−30 | 204 | 760 |
| Gm03:3933370 | A | 112:0, 0:8 | 1.000, 0.000 | 120 | 6.33E−28 | 1347 | 1348 |
| Gm03:3933900 | G | 114:0, 0:18 | 1.000, 0.000 | 132 | 1.50E−30 | 205 | 761 |
| Gm03:3933945 | C | 114:0, 0:18 | 1.000, 0.000 | 132 | 1.50E−30 | 206 | 762 |
| Gm03:3934403 | G | 114:0, 0:18 | 1.000, 0.000 | 132 | 1.50E−30 | 207 | 763 |
| Gm03:3934964 | G | 114:0, 0:12 | 1.000, 0.000 | 126 | 3.07E−29 | 208 | 764 |
| Gm03:3935036 | G | 114:0, 0:16 | 1.000, 0.000 | 130 | 4.10E−30 | 209 | 765 |
| Gm03:3935832 | G | 114:0, 0:16 | 1.000, 0.000 | 130 | 4.10E−30 | 210 | 766 |
| Gm03:3935884 | T | 114:0, 0:16 | 1.000, 0.000 | 130 | 4.10E−30 | 211 | 767 |
| Gm03:3939831 | C | 112:0, 0:18 | 1.000, 0.000 | 130 | 4.10E−30 | 212 | 768 |
| Gm03:3939836 | G | 114:0, 0:18 | 1.000, 0.000 | 132 | 1.50E−30 | 213 | 769 |
| Gm03:3939936 | T | 114:0, 0:6 | 1.000, 0.000 | 120 | 6.33E−28 | 214 | 770 |
| Gm03:3939939 | G | 114:0, 0:6 | 1.000, 0.000 | 120 | 6.33E−28 | 215 | 771 |
| Gm03:3940174 | T | 114:0, 0:14 | 1.000, 0.000 | 128 | 1.12E−29 | 216 | 772 |
| Gm03:3940396 | C | 114:0, 0:18 | 1.000, 0.000 | 132 | 1.50E−30 | 217 | 773 |
| Gm03:3940836 | T | 114:0, 0:6 | 1.000, 0.000 | 120 | 6.33E−28 | 218 | 774 |
| Gm03:3941262 | A | 112:0, 0:16 | 1.000, 0.000 | 128 | 1.12E−29 | 219 | 775 |
| Gm03:3941484 | A | 114:0, 0:14 | 1.000, 0.000 | 128 | 1.12E−29 | 220 | 776 |
| Gm03:3941769 | T | 114:0, 0:10 | 1.000, 0.000 | 124 | 8.42E−29 | 221 | 777 |
| Gm03:3942973 | C | 114:0, 0:12 | 1.000, 0.000 | 126 | 3.07E−29 | 222 | 778 |
| Gm03:3943092 | A | 114:0, 0:8 | 1.000, 0.000 | 122 | 2.31E−28 | 223 | 779 |
| Gm03:3944671 | T | 114:0, 0:12 | 1.000, 0.000 | 126 | 3.07E−29 | 224 | 780 |
| Gm03:3944738 | C | 114:0, 0:6 | 1.000, 0.000 | 120 | 6.33E−28 | 225 | 781 |
| Gm03:3945112 | A | 114:0, 0:16 | 1.000, 0.000 | 130 | 4.10E−30 | 226 | 782 |
| Gm03:3945208 | T | 114:0, 0:12 | 1.000, 0.000 | 126 | 3.07E−29 | 227 | 783 |
| Gm03:3947836 | T | 114:0, 0:6 | 1.000, 0.000 | 120 | 6.33E−28 | 228 | 784 |
| Gm03:3947860 | G | 114:0, 0:6 | 1.000, 0.000 | 120 | 6.33E−28 | 229 | 785 |
| Gm03:3949250 | C | 114:0, 0:18 | 1.000, 0.000 | 132 | 1.50E−30 | 230 | 786 |
| Gm03:3949680 | A | 114:0, 0:18 | 1.000, 0.000 | 132 | 1.50E−30 | 231 | 787 |
| Gm03:3951187 | G | 114:0, 0:8 | 1.000, 0.000 | 122 | 2.31E−28 | 232 | 788 |
| Gm03:3951201 | G | 114:0, 0:8 | 1.000, 0.000 | 122 | 2.31E−28 | 233 | 789 |
| Gm03:3951485 | C | 114:0, 0:18 | 1.000, 0.000 | 132 | 1.50E−30 | 234 | 790 |
| Gm03:3951603 | C | 114:0, 0:18 | 1.000, 0.000 | 132 | 1.50E−30 | 235 | 791 |
| Gm03:3951705 | A | 114:0, 0:14 | 1.000, 0.000 | 128 | 1.12E−29 | 236 | 792 |
| Gm03:3951715 | G | 114:0, 0:16 | 1.000, 0.000 | 130 | 4.10E−30 | 237 | 793 |
| Gm03:3952778 | T | 114:0, 0:8 | 1.000, 0.000 | 122 | 2.31E−28 | 1349 | 1350 |
| Gm03:3952811 | T | 114:0, 0:18 | 1.000, 0.000 | 132 | 1.50E−30 | 1351 | 1352 |
| Gm03:3955716 | T | 114:0, 0:12 | 1.000, 0.000 | 126 | 3.07E−29 | 238 | 794 |
| Gm03:3956414 | T | 114:0, 0:12 | 1.000, 0.000 | 126 | 3.07E−29 | 239 | 795 |
| Gm03:3958402 | A | 114:0, 0:12 | 1.000, 0.000 | 126 | 3.07E−29 | 240 | 796 |
| Gm03:3960626 | T | 114:0, 0:12 | 1.000, 0.000 | 126 | 3.07E−29 | 241 | 797 |
| Gm03:3962904 | A | 114:0, 0:8 | 1.000, 0.000 | 122 | 2.31E−28 | 242 | 798 |
| Gm03:3967880 | T | 114:0, 0:18 | 1.000, 0.000 | 132 | 1.50E−30 | 243 | 799 |
| Gm03:3968334 | G | 114:0, 0:14 | 1.000, 0.000 | 128 | 1.12E−29 | 1353 | 1354 |
| Gm03:3971607 | C | 114:0, 0:18 | 1.000, 0.000 | 132 | 1.50E−30 | 244 | 800 |
| Gm03:3971640 | C | 114:0, 0:18 | 1.000, 0.000 | 132 | 1.50E−30 | 245 | 801 |
| Gm03:3971692 | T | 114:0, 0:18 | 1.000, 0.000 | 132 | 1.50E−30 | 246 | 802 |
| Gm03:3975817 | T | 114:0, 0:18 | 1.000, 0.000 | 132 | 1.50E−30 | 247 | 803 |
| Gm03:3975824 | T | 114:0, 0:18 | 1.000, 0.000 | 132 | 1.50E−30 | 248 | 804 |
| Gm03:3976645 | T | 114:0, 0:12 | 1.000, 0.000 | 126 | 3.07E−29 | 249 | 805 |
| Gm03:3980566 | T | 114:0, 0:18 | 1.000, 0.000 | 132 | 1.50E−30 | 250 | 806 |
| Gm03:3981623 | A | 114:0, 0:12 | 1.000, 0.000 | 126 | 3.07E−29 | 251 | 807 |
| Gm03:3981822 | A | 112:0, 0:6 | 1.000, 0.000 | 118 | 1.73E−27 | 252 | 808 |
| Gm03:3982138 | C | 114:0, 0:12 | 1.000, 0.000 | 126 | 3.07E−29 | 253 | 809 |
| Gm03:3982678 | A | 114:0, 0:16 | 1.000, 0.000 | 130 | 4.10E−30 | 254 | 810 |
| Gm03:3984554 | C | 114:0, 0:4 | 1.000, 0.000 | 118 | 1.73E−27 | 255 | 811 |
| Gm03:3986094 | T | 114:0, 0:6 | 1.000, 0.000 | 120 | 6.33E−28 | 256 | 812 |
| Gm03:3987393 | C | 114:0, 0:4 | 1.000, 0.000 | 118 | 1.73E−27 | 257 | 813 |
| Gm03:3990954 | T | 114:0, 0:6 | 1.000, 0.000 | 120 | 6.33E−28 | 258 | 814 |
| Gm03:3992071 | C | 114:0, 0:10 | 1.000, 0.000 | 124 | 8.42E−29 | 259 | 815 |
| Gm03:3995556 | C | 112:0, 0:18 | 1.000, 0.000 | 130 | 4.10E−30 | 260 | 816 |

TABLE 9-continued

| Name | Assoc Allele | Case, Control Ratio Counts | Case, Control Frequencies | Chi Square | P-value | Ref. Sequence SEQ ID NO (Res.) | Ref. Sequence SEQ ID NO (Sus.) |
|---|---|---|---|---|---|---|---|
| Gm03:3996269 | C | 114:0, 0:8 | 1.000, 0.000 | 122 | 2.31E−28 | 261 | 817 |
| Gm03:3996600 | T | 114:0, 0:14 | 1.000, 0.000 | 128 | 1.12E−29 | 262 | 818 |
| Gm03:3997028 | C | 114:0, 0:16 | 1.000, 0.000 | 130 | 4.10E−30 | 263 | 819 |
| Gm03:3998157 | G | 114:0, 0:12 | 1.000, 0.000 | 126 | 3.07E−29 | 264 | 820 |
| Gm03:3998162 | G | 114:0, 0:12 | 1.000, 0.000 | 126 | 3.07E−29 | 265 | 821 |
| Gm03:3998381 | T | 112:0, 0:18 | 1.000, 0.000 | 130 | 4.10E−30 | 266 | 822 |
| Gm03:3998421 | T | 110:0, 0:18 | 1.000, 0.000 | 128 | 1.12E−29 | 267 | 823 |
| Gm03:3999241 | T | 114:0, 0:16 | 1.000, 0.000 | 130 | 4.10E−30 | 268 | 824 |
| Gm03:3999386 | C | 114:0, 0:16 | 1.000, 0.000 | 130 | 4.10E−30 | 269 | 825 |
| Gm03:3999666 | A | 114:0, 0:16 | 1.000, 0.000 | 130 | 4.10E−30 | 270 | 826 |
| Gm03:4000684 | C | 114:0, 0:18 | 1.000, 0.000 | 132 | 1.50E−30 | 1355 | 1356 |
| Gm03:4001327 | A | 114:0, 0:14 | 1.000, 0.000 | 128 | 1.12E−29 | 271 | 827 |
| Gm03:4001783 | A | 112:0, 0:6 | 1.000, 0.000 | 118 | 1.73E−27 | 272 | 828 |
| Gm03:4002016 | C | 112:0, 0:12 | 1.000, 0.000 | 124 | 8.42E−29 | 273 | 829 |
| Gm03:4005770 | T | 114:0, 0:18 | 1.000, 0.000 | 132 | 1.50E−30 | 274 | 830 |
| Gm03:4008187 | G | 114:0, 0:16 | 1.000, 0.000 | 130 | 4.10E−30 | 275 | 831 |
| Gm03:4008673 | A | 114:0, 0:16 | 1.000, 0.000 | 130 | 4.10E−30 | 276 | 832 |
| Gm03:4008687 | A | 114:0, 0:16 | 1.000, 0.000 | 130 | 4.10E−30 | 277 | 833 |
| Gm03:4010191 | C | 114:0, 0:16 | 1.000, 0.000 | 130 | 4.10E−30 | 278 | 834 |
| Gm03:4018588 | A | 114:0, 0:12 | 1.000, 0.000 | 126 | 3.07E−29 | 279 | 835 |
| Gm03:4019384 | T | 114:0, 0:10 | 1.000, 0.000 | 124 | 8.42E−29 | 280 | 836 |
| Gm03:4019896 | A | 114:0, 0:8 | 1.000, 0.000 | 122 | 2.31E−28 | 281 | 837 |
| Gm03:4020751 | T | 114:0, 0:8 | 1.000, 0.000 | 122 | 2.31E−28 | 282 | 838 |
| Gm03:4021281 | G | 114:0, 0:8 | 1.000, 0.000 | 122 | 2.31E−28 | 283 | 839 |
| Gm03:4021291 | A | 114:0, 0:8 | 1.000, 0.000 | 122 | 2.31E−28 | 284 | 840 |
| Gm03:4022234 | T | 114:0, 0:8 | 1.000, 0.000 | 122 | 2.31E−28 | 285 | 841 |
| Gm03:4022275 | T | 114:0, 0:14 | 1.000, 0.000 | 128 | 1.12E−29 | 286 | 842 |
| Gm03:4022530 | A | 114:0, 0:8 | 1.000, 0.000 | 122 | 2.31E−28 | 287 | 843 |
| Gm03:4022872 | A | 114:0, 0:18 | 1.000, 0.000 | 132 | 1.50E−30 | 288 | 844 |
| Gm03:4022934 | A | 114:0, 0:8 | 1.000, 0.000 | 122 | 2.31E−28 | 289 | 845 |
| Gm03:4023283 | T | 114:0, 0:14 | 1.000, 0.000 | 128 | 1.12E−29 | 290 | 846 |
| Gm03:4023522 | C | 114:0, 0:8 | 1.000, 0.000 | 122 | 2.31E−28 | 291 | 847 |
| Gm03:4024184 | C | 114:0, 0:16 | 1.000, 0.000 | 130 | 4.10E−30 | 292 | 848 |
| Gm03:4024294 | T | 114:0, 0:8 | 1.000, 0.000 | 122 | 2.31E−28 | 293 | 849 |
| Gm03:4024485 | A | 114:0, 0:8 | 1.000, 0.000 | 122 | 2.31E−28 | 294 | 850 |
| Gm03:4024630 | T | 114:0, 0:8 | 1.000, 0.000 | 122 | 2.31E−28 | 295 | 851 |
| Gm03:4024844 | T | 114:0, 0:8 | 1.000, 0.000 | 122 | 2.31E−28 | 296 | 852 |
| Gm03:4025056 | A | 114:0, 0:8 | 1.000, 0.000 | 122 | 2.31E−28 | 297 | 853 |
| Gm03:4026652 | T | 114:0, 0:8 | 1.000, 0.000 | 122 | 2.31E−28 | 298 | 854 |
| Gm03:4028481 | G | 114:0, 0:8 | 1.000, 0.000 | 122 | 2.31E−28 | 299 | 855 |
| Gm03:4028849 | A | 114:0, 0:12 | 1.000, 0.000 | 126 | 3.07E−29 | 300 | 856 |
| Gm03:4028961 | A | 114:0, 0:12 | 1.000, 0.000 | 126 | 3.07E−29 | 301 | 857 |
| Gm03:4029068 | A | 114:0, 0:14 | 1.000, 0.000 | 128 | 1.12E−29 | 302 | 858 |
| Gm03:4029809 | T | 114:0, 0:12 | 1.000, 0.000 | 126 | 3.07E−29 | 303 | 859 |
| Gm03:4031277 | G | 114:0, 0:12 | 1.000, 0.000 | 126 | 3.07E−29 | 304 | 860 |
| Gm03:4031983 | C | 114:0, 0:8 | 1.000, 0.000 | 122 | 2.31E−28 | 305 | 861 |
| Gm03:4031997 | G | 114:0, 0:8 | 1.000, 0.000 | 122 | 2.31E−28 | 306 | 862 |
| Gm03:4032705 | T | 114:0, 0:14 | 1.000, 0.000 | 128 | 1.12E−29 | 307 | 863 |
| Gm03:4035600 | T | 114:0, 0:18 | 1.000, 0.000 | 132 | 1.50E−30 | 308 | 864 |
| Gm03:4035918 | A | 114:0, 0:18 | 1.000, 0.000 | 132 | 1.50E−30 | 1357 | 1358 |
| Gm03:4036376 | A | 114:0, 0:14 | 1.000, 0.000 | 128 | 1.12E−29 | 309 | 865 |
| Gm03:4040874 | A | 114:0, 0:18 | 1.000, 0.000 | 132 | 1.50E−30 | 310 | 866 |
| Gm03:4041301 | T | 114:0, 0:18 | 1.000, 0.000 | 132 | 1.50E−30 | 311 | 867 |
| Gm03:4041795 | A | 114:0, 0:12 | 1.000, 0.000 | 126 | 3.07E−29 | 312 | 868 |
| Gm03:4042572 | G | 114:0, 0:18 | 1.000, 0.000 | 132 | 1.50E−30 | 313 | 869 |
| Gm03:4042679 | T | 114:0, 0:18 | 1.000, 0.000 | 132 | 1.50E−30 | 314 | 870 |
| Gm03:4042697 | A | 114:0, 0:16 | 1.000, 0.000 | 130 | 4.10E−30 | 315 | 871 |
| Gm03:4043007 | A | 114:0, 0:18 | 1.000, 0.000 | 132 | 1.50E−30 | 316 | 872 |
| Gm03:4043140 | A | 114:0, 0:18 | 1.000, 0.000 | 132 | 1.50E−30 | 317 | 873 |
| Gm03:4043823 | T | 114:0, 0:18 | 1.000, 0.000 | 132 | 1.50E−30 | 318 | 874 |
| Gm03:4043978 | C | 114:0, 0:18 | 1.000, 0.000 | 132 | 1.50E−30 | 319 | 875 |
| Gm03:4044534 | T | 114:0, 0:18 | 1.000, 0.000 | 132 | 1.50E−30 | 320 | 876 |
| Gm03:4044555 | T | 114:0, 0:18 | 1.000, 0.000 | 132 | 1.50E−30 | 321 | 877 |
| Gm03:4044972 | A | 114:0, 0:16 | 1.000, 0.000 | 130 | 4.10E−30 | 322 | 878 |
| Gm03:4045630 | A | 114:0, 0:16 | 1.000, 0.000 | 130 | 4.10E−30 | 323 | 879 |
| Gm03:4046313 | C | 114:0, 0:18 | 1.000, 0.000 | 132 | 1.50E−30 | 324 | 880 |
| Gm03:4049555 | T | 114:0, 0:10 | 1.000, 0.000 | 124 | 8.42E−29 | 325 | 881 |
| Gm03:4049791 | T | 114:0, 0:18 | 1.000, 0.000 | 132 | 1.50E−30 | 326 | 882 |
| Gm03:4049877 | T | 114:0, 0:8 | 1.000, 0.000 | 122 | 2.31E−28 | 327 | 883 |
| Gm03:4050197 | A | 112:0, 0:16 | 1.000, 0.000 | 128 | 1.12E−29 | 328 | 884 |
| Gm03:4053685 | T | 114:0, 0:12 | 1.000, 0.000 | 126 | 3.07E−29 | 329 | 885 |
| Gm03:4053838 | T | 114:0, 0:10 | 1.000, 0.000 | 124 | 8.42E−29 | 330 | 886 |
| Gm03:4054927 | T | 114:0, 0:12 | 1.000, 0.000 | 126 | 3.07E−29 | 331 | 887 |
| Gm03:4055100 | A | 114:0, 0:12 | 1.000, 0.000 | 126 | 3.07E−29 | 332 | 888 |
| Gm03:4055384 | A | 114:0, 0:10 | 1.000, 0.000 | 124 | 8.42E−29 | 333 | 889 |

TABLE 9-continued

| Name | Assoc Allele | Case, Control Ratio Counts | Case, Control Frequencies | Chi Square | P-value | Ref. Sequence SEQ ID NO (Res.) | Ref. Sequence SEQ ID NO (Sus.) |
|---|---|---|---|---|---|---|---|
| Gm03:4055427 | T | 114:0, 0:12 | 1.000, 0.000 | 126 | 3.07E−29 | 334 | 890 |
| Gm03:4055483 | A | 114:0, 0:10 | 1.000, 0.000 | 124 | 8.42E−29 | 1359 | 1360 |
| Gm03:4062751 | A | 114:0, 0:12 | 1.000, 0.000 | 126 | 3.07E−29 | 335 | 891 |
| Gm03:4062885 | A | 114:0, 0:12 | 1.000, 0.000 | 126 | 3.07E−29 | 1361 | 1362 |
| Gm03:4064351 | T | 114:0, 0:10 | 1.000, 0.000 | 124 | 8.42E−29 | 336 | 892 |
| Gm03:4064592 | A | 114:0, 0:12 | 1.000, 0.000 | 126 | 3.07E−29 | 337 | 893 |
| Gm03:4064759 | T | 114:0, 0:10 | 1.000, 0.000 | 124 | 8.42E−29 | 338 | 894 |
| Gm03:4064811 | T | 114:0, 0:10 | 1.000, 0.000 | 124 | 8.42E−29 | 339 | 895 |
| Gm03:4064957 | C | 114:0, 0:10 | 1.000, 0.000 | 124 | 8.42E−29 | 340 | 896 |
| Gm03:4065083 | T | 114:0, 0:10 | 1.000, 0.000 | 124 | 8.42E−29 | 341 | 897 |
| Gm03:4066234 | A | 114:0, 0:12 | 1.000, 0.000 | 126 | 3.07E−29 | 342 | 898 |
| Gm03:4066331 | A | 114:0, 0:12 | 1.000, 0.000 | 126 | 3.07E−29 | 343 | 899 |
| Gm03:4067099 | A | 114:0, 0:10 | 1.000, 0.000 | 124 | 8.42E−29 | 344 | 900 |
| Gm03:4067514 | T | 114:0, 0:10 | 1.000, 0.000 | 124 | 8.42E−29 | 345 | 901 |
| Gm03:4069037 | T | 114:0, 0:6 | 1.000, 0.000 | 120 | 6.33E−28 | 346 | 902 |
| Gm03:4069603 | T | 114:0, 0:8 | 1.000, 0.000 | 122 | 2.31E−28 | 347 | 903 |
| Gm03:4070422 | G | 114:0, 0:12 | 1.000, 0.000 | 126 | 3.07E−29 | 348 | 904 |
| Gm03:4072567 | T | 114:0, 0:10 | 1.000, 0.000 | 124 | 8.42E−29 | 349 | 905 |
| Gm03:4074190 | T | 112:0, 0:10 | 1.000, 0.000 | 122 | 2.31E−28 | 350 | 906 |
| Gm03:4075232 | G | 114:0, 0:10 | 1.000, 0.000 | 124 | 8.42E−29 | 351 | 907 |
| Gm03:4076404 | T | 114:0, 0:10 | 1.000, 0.000 | 124 | 8.42E−29 | 352 | 908 |
| Gm03:4078299 | T | 114:0, 0:12 | 1.000, 0.000 | 126 | 3.07E−29 | 353 | 909 |
| Gm03:4078902 | C | 114:0, 0:12 | 1.000, 0.000 | 126 | 3.07E−29 | 354 | 910 |
| Gm03:4080136 | A | 114:0, 0:10 | 1.000, 0.000 | 124 | 8.42E−29 | 355 | 911 |
| Gm03:4081056 | T | 114:0, 0:8 | 1.000, 0.000 | 122 | 2.31E−28 | 356 | 912 |
| Gm03:4081889 | A | 114:0, 0:12 | 1.000, 0.000 | 126 | 3.07E−29 | 357 | 913 |
| Gm03:4082200 | G | 114:0, 0:10 | 1.000, 0.000 | 124 | 8.42E−29 | 358 | 914 |
| Gm03:4082590 | C | 114:0, 0:12 | 1.000, 0.000 | 126 | 3.07E−29 | 359 | 915 |
| Gm03:4082701 | A | 114:0, 0:12 | 1.000, 0.000 | 126 | 3.07E−29 | 360 | 916 |
| Gm03:4082781 | G | 114:0, 0:12 | 1.000, 0.000 | 126 | 3.07E−29 | 361 | 917 |
| Gm03:4082871 | A | 114:0, 0:12 | 1.000, 0.000 | 126 | 3.07E−29 | 362 | 918 |
| Gm03:4083114 | T | 114:0, 0:12 | 1.000, 0.000 | 126 | 3.07E−29 | 363 | 919 |
| Gm03:4084001 | G | 114:0, 0:8 | 1.000, 0.000 | 122 | 2.31E−28 | 364 | 920 |
| Gm03:4084095 | A | 114:0, 0:12 | 1.000, 0.000 | 126 | 3.07E−29 | 365 | 921 |
| Gm03:4085042 | T | 114:0, 0:10 | 1.000, 0.000 | 124 | 8.42E−29 | 366 | 922 |
| Gm03:4085524 | T | 114:0, 0:10 | 1.000, 0.000 | 124 | 8.42E−29 | 367 | 923 |
| Gm03:4086286 | A | 114:0, 0:10 | 1.000, 0.000 | 124 | 8.42E−29 | 368 | 924 |
| Gm03:4086887 | T | 114:0, 0:10 | 1.000, 0.000 | 124 | 8.42E−29 | 369 | 925 |
| Gm03:4087383 | T | 114:0, 0:10 | 1.000, 0.000 | 124 | 8.42E−29 | 370 | 926 |
| Gm03:4088310 | T | 114:0, 0:10 | 1.000, 0.000 | 124 | 8.42E−29 | 371 | 927 |
| Gm03:4090188 | C | 114:0, 0:10 | 1.000, 0.000 | 124 | 8.42E−29 | 372 | 928 |
| Gm03:4092799 | A | 114:0, 0:10 | 1.000, 0.000 | 124 | 8.42E−29 | 373 | 929 |
| Gm03:4092928 | T | 114:0, 0:10 | 1.000, 0.000 | 124 | 8.42E−29 | 374 | 930 |
| Gm03:4093195 | G | 114:0, 0:10 | 1.000, 0.000 | 124 | 8.42E−29 | 375 | 931 |
| Gm03:4093240 | T | 114:0, 0:10 | 1.000, 0.000 | 124 | 8.42E−29 | 376 | 932 |
| Gm03:4097291 | T | 114:0, 0:10 | 1.000, 0.000 | 124 | 8.42E−29 | 377 | 933 |
| Gm03:4097563 | A | 114:0, 0:10 | 1.000, 0.000 | 124 | 8.42E−29 | 378 | 934 |
| Gm03:4097729 | A | 114:0, 0:10 | 1.000, 0.000 | 124 | 8.42E−29 | 379 | 935 |
| Gm03:4098328 | A | 114:0, 0:10 | 1.000, 0.000 | 124 | 8.42E−29 | 380 | 936 |
| Gm03:4100831 | A | 114:0, 0:6 | 1.000, 0.000 | 120 | 6.33E−28 | 1363 | 1364 |
| Gm03:4101257 | A | 114:0, 0:10 | 1.000, 0.000 | 124 | 8.42E−29 | 381 | 937 |
| Gm03:4103342 | C | 114:0, 0:10 | 1.000, 0.000 | 124 | 8.42E−29 | 382 | 938 |
| Gm03:4103449 | T | 114:0, 0:8 | 1.000, 0.000 | 122 | 2.31E−28 | 383 | 939 |
| Gm03:4103450 | G | 114:0, 0:8 | 1.000, 0.000 | 122 | 2.31E−28 | 384 | 940 |
| Gm03:4103515 | T | 114:0, 0:8 | 1.000, 0.000 | 122 | 2.31E−28 | 385 | 941 |
| Gm03:4103547 | T | 114:0, 0:10 | 1.000, 0.000 | 124 | 8.42E−29 | 386 | 942 |
| Gm03:4103633 | T | 114:0, 0:10 | 1.000, 0.000 | 124 | 8.42E−29 | 387 | 943 |
| Gm03:4104502 | T | 114:0, 0:10 | 1.000, 0.000 | 124 | 8.42E−29 | 388 | 944 |
| Gm03:4106406 | C | 114:0, 0:10 | 1.000, 0.000 | 124 | 8.42E−29 | 389 | 945 |
| Gm03:4109228 | A | 114:0, 0:10 | 1.000, 0.000 | 124 | 8.42E−29 | 390 | 946 |
| Gm03:4110012 | C | 114:0, 0:10 | 1.000, 0.000 | 124 | 8.42E−29 | 391 | 947 |
| Gm03:4110449 | A | 114:0, 0:10 | 1.000, 0.000 | 124 | 8.42E−29 | 392 | 948 |
| Gm03:4110821 | G | 114:0, 0:10 | 1.000, 0.000 | 124 | 8.42E−29 | 393 | 949 |
| Gm03:4111538 | T | 114:0, 0:10 | 1.000, 0.000 | 124 | 8.42E−29 | 394 | 950 |
| Gm03:4113757 | A | 114:0, 0:10 | 1.000, 0.000 | 124 | 8.42E−29 | 395 | 951 |
| Gm03:4116726 | T | 114:0, 0:10 | 1.000, 0.000 | 124 | 8.42E−29 | 396 | 952 |
| Gm03:4117330 | T | 114:0, 0:10 | 1.000, 0.000 | 124 | 8.42E−29 | 397 | 953 |
| Gm03:4117375 | G | 114:0, 0:10 | 1.000, 0.000 | 124 | 8.42E−29 | 398 | 954 |
| Gm03:4117779 | C | 114:0, 0:10 | 1.000, 0.000 | 124 | 8.42E−29 | 399 | 955 |
| Gm03:4117890 | C | 114:0, 0:10 | 1.000, 0.000 | 124 | 8.42E−29 | 400 | 956 |
| Gm03:4117986 | G | 114:0, 0:10 | 1.000, 0.000 | 124 | 8.42E−29 | 401 | 957 |
| Gm03:4120433 | T | 114:0, 0:10 | 1.000, 0.000 | 124 | 8.42E−29 | 402 | 958 |
| Gm03:4120705 | G | 114:0, 0:10 | 1.000, 0.000 | 124 | 8.42E−29 | 403 | 959 |
| Gm03:4122180 | C | 114:0, 0:10 | 1.000, 0.000 | 124 | 8.42E−29 | 404 | 960 |
| Gm03:4129251 | T | 114:0, 0:10 | 1.000, 0.000 | 124 | 8.42E−29 | 405 | 961 |

TABLE 9-continued

| Name | Assoc Allele | Case, Control Ratio Counts | Case, Control Frequencies | Chi Square | P-value | Ref. Sequence SEQ ID NO (Res.) | Ref. Sequence SEQ ID NO (Sus.) |
|---|---|---|---|---|---|---|---|
| Gm03:4129479 | T | 114:0, 0:10 | 1.000, 0.000 | 124 | 8.42E−29 | 406 | 962 |
| Gm03:4129635 | T | 114:0, 0:10 | 1.000, 0.000 | 124 | 8.42E−29 | 407 | 963 |
| Gm03:4130393 | T | 114:0, 0:10 | 1.000, 0.000 | 124 | 8.42E−29 | 408 | 964 |
| Gm03:4131257 | T | 114:0, 0:10 | 1.000, 0.000 | 124 | 8.42E−29 | 409 | 965 |
| Gm03:4132032 | C | 114:0, 0:8 | 1.000, 0.000 | 122 | 2.31E−28 | 410 | 966 |
| Gm03:4132192 | A | 114:0, 0:12 | 1.000, 0.000 | 126 | 3.07E−29 | 411 | 967 |
| Gm03:4133520 | C | 114:0, 0:10 | 1.000, 0.000 | 124 | 8.42E−29 | 412 | 968 |
| Gm03:4134606 | A | 114:0, 0:10 | 1.000, 0.000 | 124 | 8.42E−29 | 413 | 969 |
| Gm03:4134679 | A | 114:0, 0:10 | 1.000, 0.000 | 124 | 8.42E−29 | 414 | 970 |
| Gm03:4136487 | T | 114:0, 0:10 | 1.000, 0.000 | 124 | 8.42E−29 | 415 | 971 |
| Gm03:4136724 | T | 114:0, 0:10 | 1.000, 0.000 | 124 | 8.42E−29 | 416 | 972 |
| Gm03:4136742 | T | 114:0, 0:10 | 1.000, 0.000 | 124 | 8.42E−29 | 417 | 973 |
| Gm03:4136791 | A | 114:0, 0:10 | 1.000, 0.000 | 124 | 8.42E−29 | 418 | 974 |
| Gm03:4136972 | T | 114:0, 0:10 | 1.000, 0.000 | 124 | 8.42E−29 | 419 | 975 |
| Gm03:4137137 | T | 114:0, 0:10 | 1.000, 0.000 | 124 | 8.42E−29 | 420 | 976 |
| Gm03:4137521 | C | 114:0, 0:10 | 1.000, 0.000 | 124 | 8.42E−29 | 421 | 977 |
| Gm03:4137540 | G | 114:0, 0:10 | 1.000, 0.000 | 124 | 8.42E−29 | 422 | 978 |
| Gm03:4137645 | A | 114:0, 0:10 | 1.000, 0.000 | 124 | 8.42E−29 | 423 | 979 |
| Gm03:4138435 | T | 114:0, 0:10 | 1.000, 0.000 | 124 | 8.42E−29 | 424 | 980 |
| Gm03:4138980 | A | 114:0, 0:10 | 1.000, 0.000 | 124 | 8.42E−29 | 425 | 981 |
| Gm03:4139156 | A | 114:0, 0:10 | 1.000, 0.000 | 124 | 8.42E−29 | 426 | 982 |
| Gm03:4139395 | C | 114:0, 0:10 | 1.000, 0.000 | 124 | 8.42E−29 | 1365 | 1366 |
| Gm03:4140035 | C | 114:0, 0:8 | 1.000, 0.000 | 122 | 2.31E−28 | 427 | 983 |
| Gm03:4140071 | T | 114:0, 0:8 | 1.000, 0.000 | 122 | 2.31E−28 | 428 | 984 |
| Gm03:4140976 | A | 114:0, 0:10 | 1.000, 0.000 | 124 | 8.42E−29 | 429 | 985 |
| Gm03:4141074 | T | 114:0, 0:10 | 1.000, 0.000 | 124 | 8.42E−29 | 430 | 986 |
| Gm03:4141090 | A | 114:0, 0:10 | 1.000, 0.000 | 124 | 8.42E−29 | 431 | 987 |
| Gm03:4141251 | T | 114:0, 0:10 | 1.000, 0.000 | 124 | 8.42E−29 | 432 | 988 |
| Gm03:4141363 | T | 114:0, 0:10 | 1.000, 0.000 | 124 | 8.42E−29 | 433 | 989 |
| Gm03:4141488 | A | 114:0, 0:10 | 1.000, 0.000 | 124 | 8.42E−29 | 434 | 990 |
| Gm03:4142353 | A | 114:0, 0:10 | 1.000, 0.000 | 124 | 8.42E−29 | 435 | 991 |
| Gm03:4142380 | C | 114:0, 0:10 | 1.000, 0.000 | 124 | 8.42E−29 | 436 | 992 |
| Gm03:4142693 | T | 114:0, 0:10 | 1.000, 0.000 | 124 | 8.42E−29 | 437 | 993 |
| Gm03:4142800 | T | 114:0, 0:10 | 1.000, 0.000 | 124 | 8.42E−29 | 438 | 994 |
| Gm03:4142810 | T | 114:0, 0:10 | 1.000, 0.000 | 124 | 8.42E−29 | 439 | 995 |
| Gm03:4143060 | A | 114:0, 0:10 | 1.000, 0.000 | 124 | 8.42E−29 | 440 | 996 |
| Gm03:4143112 | A | 114:0, 0:8 | 1.000, 0.000 | 122 | 2.31E−28 | 441 | 997 |
| Gm03:4143113 | T | 114:0, 0:10 | 1.000, 0.000 | 124 | 8.42E−29 | 442 | 998 |
| Gm03:4144137 | T | 114:0, 0:10 | 1.000, 0.000 | 124 | 8.42E−29 | 443 | 999 |
| Gm03:4144350 | T | 114:0, 0:10 | 1.000, 0.000 | 124 | 8.42E−29 | 444 | 1000 |
| Gm03:4144639 | T | 114:0, 0:10 | 1.000, 0.000 | 124 | 8.42E−29 | 445 | 1001 |
| Gm03:4145737 | A | 114:0, 0:10 | 1.000, 0.000 | 124 | 8.42E−29 | 446 | 1002 |
| Gm03:4145959 | C | 114:0, 0:10 | 1.000, 0.000 | 124 | 8.42E−29 | 447 | 1003 |
| Gm03:4145974 | G | 114:0, 0:10 | 1.000, 0.000 | 124 | 8.42E−29 | 448 | 1004 |
| Gm03:4146284 | A | 114:0, 0:10 | 1.000, 0.000 | 124 | 8.42E−29 | 449 | 1005 |
| Gm03:4147289 | C | 114:0, 0:10 | 1.000, 0.000 | 124 | 8.42E−29 | 450 | 1006 |
| Gm03:4147425 | C | 114:0, 0:10 | 1.000, 0.000 | 124 | 8.42E−29 | 451 | 1007 |
| Gm03:4148248 | A | 114:0, 0:10 | 1.000, 0.000 | 124 | 8.42E−29 | 452 | 1008 |
| Gm03:4148643 | C | 114:0, 0:10 | 1.000, 0.000 | 124 | 8.42E−29 | 453 | 1009 |
| Gm03:4148732 | A | 114:0, 0:10 | 1.000, 0.000 | 124 | 8.42E−29 | 454 | 1010 |
| Gm03:4149880 | A | 114:0, 0:8 | 1.000, 0.000 | 122 | 2.31E−28 | 1367 | 1368 |
| Gm03:4149919 | A | 114:0, 0:10 | 1.000, 0.000 | 124 | 8.42E−29 | 455 | 1011 |
| Gm03:4150189 | C | 114:0, 0:10 | 1.000, 0.000 | 124 | 8.42E−29 | 456 | 1012 |
| Gm03:4150330 | T | 114:0, 0:10 | 1.000, 0.000 | 124 | 8.42E−29 | 457 | 1013 |
| Gm03:4151366 | A | 114:0, 0:10 | 1.000, 0.000 | 124 | 8.42E−29 | 458 | 1014 |
| Gm03:4152106 | T | 114:0, 0:10 | 1.000, 0.000 | 124 | 8.42E−29 | 459 | 1015 |
| Gm03:4153221 | A | 114:0, 0:10 | 1.000, 0.000 | 124 | 8.42E−29 | 460 | 1016 |
| Gm03:4153413 | A | 114:0, 0:10 | 1.000, 0.000 | 124 | 8.42E−29 | 461 | 1017 |
| Gm03:4153505 | C | 114:0, 0:10 | 1.000, 0.000 | 124 | 8.42E−29 | 462 | 1018 |
| Gm03:4153885 | C | 114:0, 0:10 | 1.000, 0.000 | 124 | 8.42E−29 | 463 | 1019 |
| Gm03:4154059 | A | 114:0, 0:10 | 1.000, 0.000 | 124 | 8.42E−29 | 464 | 1020 |
| Gm03:4156891 | A | 114:0, 0:12 | 1.000, 0.000 | 126 | 3.07E−29 | 465 | 1021 |
| Gm03:4158622 | G | 114:0, 0:10 | 1.000, 0.000 | 124 | 8.42E−29 | 466 | 1022 |
| Gm03:4159661 | C | 114:0, 0:10 | 1.000, 0.000 | 124 | 8.42E−29 | 467 | 1023 |
| Gm03:4160698 | C | 114:0, 0:10 | 1.000, 0.000 | 124 | 8.42E−29 | 468 | 1024 |
| Gm03:4162268 | A | 114:0, 0:10 | 1.000, 0.000 | 124 | 8.42E−29 | 469 | 1025 |
| Gm03:4163423 | G | 114:0, 0:10 | 1.000, 0.000 | 124 | 8.42E−29 | 470 | 1026 |
| Gm03:4164061 | T | 114:0, 0:10 | 1.000, 0.000 | 124 | 8.42E−29 | 471 | 1027 |
| Gm03:4164065 | T | 114:0, 0:10 | 1.000, 0.000 | 124 | 8.42E−29 | 472 | 1028 |
| Gm03:4164142 | A | 114:0, 0:10 | 1.000, 0.000 | 124 | 8.42E−29 | 473 | 1029 |
| Gm03:4164401 | A | 114:0, 0:10 | 1.000, 0.000 | 124 | 8.42E−29 | 474 | 1030 |
| Gm03:4164507 | T | 114:0, 0:10 | 1.000, 0.000 | 124 | 8.42E−29 | 475 | 1031 |
| Gm03:4164719 | A | 114:0, 0:10 | 1.000, 0.000 | 124 | 8.42E−29 | 476 | 1032 |
| Gm03:4164807 | A | 114:0, 0:10 | 1.000, 0.000 | 124 | 8.42E−29 | 477 | 1033 |
| Gm03:4166307 | C | 114:0, 0:12 | 1.000, 0.000 | 126 | 3.07E−29 | 478 | 1034 |

TABLE 9-continued

| Name | Assoc Allele | Case, Control Ratio Counts | Case, Control Frequencies | Chi Square | P-value | Ref. Sequence SEQ ID NO (Res.) | Ref. Sequence SEQ ID NO (Sus.) |
|---|---|---|---|---|---|---|---|
| Gm03:4166432 | G | 114:0, 0:12 | 1.000, 0.000 | 126 | 3.07E−29 | 479 | 1035 |
| Gm03:4167439 | C | 114:0, 0:10 | 1.000, 0.000 | 124 | 8.42E−29 | 480 | 1036 |
| Gm03:4167591 | C | 114:0, 0:12 | 1.000, 0.000 | 126 | 3.07E−29 | 481 | 1037 |
| Gm03:4167701 | A | 114:0, 0:10 | 1.000, 0.000 | 124 | 8.42E−29 | 482 | 1038 |
| Gm03:4168907 | T | 112:0, 0:12 | 1.000, 0.000 | 124 | 8.42E−29 | 483 | 1039 |
| Gm03:4169729 | A | 114:0, 0:10 | 1.000, 0.000 | 124 | 8.42E−29 | 484 | 1040 |
| Gm03:4169784 | A | 114:0, 0:8 | 1.000, 0.000 | 122 | 2.31E−28 | 485 | 1041 |
| Gm03:4169863 | G | 114:0, 0:6 | 1.000, 0.000 | 120 | 6.33E−28 | 1369 | 1370 |
| Gm03:4169950 | T | 114:0, 0:4 | 1.000, 0.000 | 118 | 1.73E−27 | 486 | 1042 |
| Gm03:4169995 | G | 112:0, 0:6 | 1.000, 0.000 | 118 | 1.73E−27 | 487 | 1043 |
| Gm03:4171393 | C | 114:0, 0:10 | 1.000, 0.000 | 124 | 8.42E−29 | 488 | 1044 |
| Gm03:4171766 | A | 112:0, 0:8 | 1.000, 0.000 | 122 | 2.31E−28 | 1371 | 1372 |
| Gm03:4172171 | A | 114:0, 0:10 | 1.000, 0.000 | 124 | 8.42E−29 | 489 | 1045 |
| Gm03:4173195 | A | 114:0, 0:10 | 1.000, 0.000 | 124 | 8.42E−29 | 490 | 1046 |
| Gm03:4173316 | A | 114:0, 0:10 | 1.000, 0.000 | 124 | 8.42E−29 | 491 | 1047 |
| Gm03:4173405 | T | 114:0, 0:10 | 1.000, 0.000 | 124 | 8.42E−29 | 492 | 1048 |
| Gm03:4173524 | A | 114:0, 0:10 | 1.000, 0.000 | 124 | 8.42E−29 | 493 | 1049 |
| Gm03:4175127 | A | 114:0, 0:10 | 1.000, 0.000 | 124 | 8.42E−29 | 494 | 1050 |
| Gm03:4177056 | A | 114:0, 0:10 | 1.000, 0.000 | 124 | 8.42E−29 | 495 | 1051 |
| Gm03:4177689 | A | 114:0, 0:10 | 1.000, 0.000 | 124 | 8.42E−29 | 496 | 1052 |
| Gm03:4177690 | G | 114:0, 0:10 | 1.000, 0.000 | 124 | 8.42E−29 | 497 | 1053 |
| Gm03:4178958 | A | 114:0, 0:8 | 1.000, 0.000 | 122 | 2.31E−28 | 498 | 1054 |
| Gm03:4179972 | T | 114:0, 0:10 | 1.000, 0.000 | 124 | 8.42E−29 | 499 | 1055 |
| Gm03:4180458 | A | 114:0, 0:12 | 1.000, 0.000 | 126 | 3.07E−29 | 500 | 1056 |
| Gm03:4182337 | G | 114:0, 0:12 | 1.000, 0.000 | 126 | 3.07E−29 | 501 | 1057 |
| Gm03:4184380 | T | 114:0, 0:12 | 1.000, 0.000 | 126 | 3.07E−29 | 502 | 1058 |
| Gm03:4184951 | T | 114:0, 0:10 | 1.000, 0.000 | 124 | 8.42E−29 | 503 | 1059 |
| Gm03:4184971 | T | 114:0, 0:10 | 1.000, 0.000 | 124 | 8.42E−29 | 504 | 1060 |
| Gm03:4185234 | A | 114:0, 0:10 | 1.000, 0.000 | 124 | 8.42E−29 | 505 | 1061 |
| Gm03:4185400 | G | 114:0, 0:10 | 1.000, 0.000 | 124 | 8.42E−29 | 506 | 1062 |
| Gm03:4185863 | T | 114:0, 0:10 | 1.000, 0.000 | 124 | 8.42E−29 | 507 | 1063 |
| Gm03:4187256 | A | 114:0, 0:10 | 1.000, 0.000 | 124 | 8.42E−29 | 508 | 1064 |
| Gm03:4188732 | T | 114:0, 0:8 | 1.000, 0.000 | 122 | 2.31E−28 | 509 | 1065 |
| Gm03:4189845 | C | 114:0, 0:10 | 1.000, 0.000 | 124 | 8.42E−29 | 510 | 1066 |
| Gm03:4189964 | T | 114:0, 0:10 | 1.000, 0.000 | 124 | 8.42E−29 | 511 | 1067 |
| Gm03:4190679 | G | 114:0, 0:10 | 1.000, 0.000 | 124 | 8.42E−29 | 512 | 1068 |
| Gm03:4191313 | A | 114:0, 0:10 | 1.000, 0.000 | 124 | 8.42E−29 | 513 | 1069 |
| Gm03:4191519 | T | 114:0, 0:10 | 1.000, 0.000 | 124 | 8.42E−29 | 514 | 1070 |
| Gm03:4192359 | T | 114:0, 0:10 | 1.000, 0.000 | 124 | 8.42E−29 | 515 | 1071 |
| Gm03:4192478 | A | 114:0, 0:10 | 1.000, 0.000 | 124 | 8.42E−29 | 516 | 1072 |
| Gm03:4192513 | T | 114:0, 0:10 | 1.000, 0.000 | 124 | 8.42E−29 | 517 | 1073 |
| Gm03:4192621 | C | 114:0, 0:12 | 1.000, 0.000 | 126 | 3.07E−29 | 518 | 1074 |
| Gm03:4192738 | G | 114:0, 0:10 | 1.000, 0.000 | 124 | 8.42E−29 | 519 | 1075 |
| Gm03:4193009 | T | 114:0, 0:10 | 1.000, 0.000 | 124 | 8.42E−29 | 520 | 1076 |
| Gm03:4193030 | G | 114:0, 0:10 | 1.000, 0.000 | 124 | 8.42E−29 | 1373 | 1374 |
| Gm03:4193039 | G | 114:0, 0:10 | 1.000, 0.000 | 124 | 8.42E−29 | 521 | 1077 |
| Gm03:4193483 | T | 114:0, 0:10 | 1.000, 0.000 | 124 | 8.42E−29 | 522 | 1078 |
| Gm03:4196188 | T | 114:0, 0:10 | 1.000, 0.000 | 124 | 8.42E−29 | 523 | 1079 |
| Gm03:4196542 | T | 114:0, 0:6 | 1.000, 0.000 | 120 | 6.33E−28 | 524 | 1080 |
| Gm03:4197697 | T | 114:0, 0:14 | 1.000, 0.000 | 128 | 1.12E−29 | 1375 | 1376 |
| Gm03:4197774 | A | 114:0, 0:16 | 1.000, 0.000 | 130 | 4.10E−30 | 525 | 1081 |
| Gm03:4198285 | A | 114:0, 0:16 | 1.000, 0.000 | 130 | 4.10E−30 | 526 | 1082 |
| Gm03:4198508 | C | 114:0, 0:10 | 1.000, 0.000 | 124 | 8.42E−29 | 527 | 1083 |
| Gm03:4198711 | A | 114:0, 0:18 | 1.000, 0.000 | 132 | 1.50E−30 | 528 | 1084 |
| Gm03:4198914 | A | 114:0, 0:16 | 1.000, 0.000 | 130 | 4.10E−30 | 529 | 1085 |
| Gm03:4199748 | G | 114:0, 0:12 | 1.000, 0.000 | 126 | 3.07E−29 | 530 | 1086 |
| Gm03:4200094 | A | 114:0, 0:18 | 1.000, 0.000 | 132 | 1.50E−30 | 531 | 1087 |
| Gm03:4203253 | G | 114:0, 0:12 | 1.000, 0.000 | 126 | 3.07E−29 | 532 | 1088 |
| Gm03:4203462 | G | 114:0, 0:12 | 1.000, 0.000 | 126 | 3.07E−29 | 533 | 1089 |
| Gm03:4203594 | C | 114:0, 0:10 | 1.000, 0.000 | 124 | 8.42E−29 | 534 | 1090 |
| Gm03:4203626 | C | 114:0, 0:10 | 1.000, 0.000 | 124 | 8.42E−29 | 535 | 1091 |
| Gm03:4204747 | A | 114:0, 0:10 | 1.000, 0.000 | 124 | 8.42E−29 | 536 | 1092 |
| Gm03:4204867 | A | 114:0, 0:12 | 1.000, 0.000 | 126 | 3.07E−29 | 537 | 1093 |
| Gm03:4205828 | C | 114:0, 0:10 | 1.000, 0.000 | 124 | 8.42E−29 | 538 | 1094 |
| Gm03:4205953 | T | 114:0, 0:10 | 1.000, 0.000 | 124 | 8.42E−29 | 539 | 1095 |
| Gm03:4206870 | G | 114:0, 0:12 | 1.000, 0.000 | 126 | 3.07E−29 | 540 | 1096 |
| Gm03:4207703 | G | 114:0, 0:10 | 1.000, 0.000 | 124 | 8.42E−29 | 541 | 1097 |
| Gm03:4215115 | C | 114:0, 0:8 | 1.000, 0.000 | 122 | 2.31E−28 | 542 | 1098 |
| Gm03:4215690 | T | 114:0, 0:10 | 1.000, 0.000 | 124 | 8.42E−29 | 543 | 1099 |
| Gm03:4215950 | A | 114:0, 0:10 | 1.000, 0.000 | 124 | 8.42E−29 | 544 | 1100 |
| Gm03:4217736 | G | 114:0, 0:10 | 1.000, 0.000 | 124 | 8.42E−29 | 545 | 1101 |
| Gm03:4218032 | C | 114:0, 0:10 | 1.000, 0.000 | 124 | 8.42E−29 | 546 | 1102 |
| Gm03:4218527 | C | 114:0, 0:10 | 1.000, 0.000 | 124 | 8.42E−29 | 547 | 1103 |
| Gm03:4218716 | G | 114:0, 0:10 | 1.000, 0.000 | 124 | 8.42E−29 | 548 | 1104 |
| Gm03:4218990 | G | 114:0, 0:10 | 1.000, 0.000 | 124 | 8.42E−29 | 549 | 1105 |

TABLE 9-continued

| Name | Assoc Allele | Case, Control Ratio Counts | Case, Control Frequencies | Chi Square | P-value | Ref. Sequence SEQ ID NO (Res.) | Ref. Sequence SEQ ID NO (Sus.) |
|---|---|---|---|---|---|---|---|
| Gm03:4219539 | A | 114:0, 0:10 | 1.000, 0.000 | 124 | 8.42E−29 | 550 | 1106 |
| Gm03:4219667 | A | 114:0, 0:10 | 1.000, 0.000 | 124 | 8.42E−29 | 551 | 1107 |
| Gm03:4221288 | T | 114:0, 0:10 | 1.000, 0.000 | 124 | 8.42E−29 | 552 | 1108 |
| Gm03:4222312 | A | 114:0, 0:10 | 1.000, 0.000 | 124 | 8.42E−29 | 553 | 1109 |
| Gm03:4223122 | A | 114:0, 0:10 | 1.000, 0.000 | 124 | 8.42E−29 | 554 | 1110 |
| Gm03:4223821 | T | 114:0, 0:10 | 1.000, 0.000 | 124 | 8.42E−29 | 555 | 1111 |
| Gm03:4224501 | T | 114:0, 0:10 | 1.000, 0.000 | 124 | 8.42E−29 | 556 | 1112 |
| Gm03:4225137 | G | 114:0, 0:10 | 1.000, 0.000 | 124 | 8.42E−29 | 557 | 1113 |
| Gm03:4225960 | A | 114:0, 0:10 | 1.000, 0.000 | 124 | 8.42E−29 | 558 | 1114 |
| Gm03:4226471 | T | 114:0, 0:10 | 1.000, 0.000 | 124 | 8.42E−29 | 559 | 1115 |
| Gm03:4227488 | C | 114:0, 0:10 | 1.000, 0.000 | 124 | 8.42E−29 | 560 | 1116 |
| Gm03:4228931 | A | 114:0, 0:10 | 1.000, 0.000 | 124 | 8.42E−29 | 561 | 1117 |
| Gm03:4229006 | C | 114:0, 0:10 | 1.000, 0.000 | 124 | 8.42E−29 | 562 | 1118 |
| Gm03:4229247 | A | 114:0, 0:10 | 1.000, 0.000 | 124 | 8.42E−29 | 563 | 1119 |
| Gm03:4230412 | A | 114:0, 0:10 | 1.000, 0.000 | 124 | 8.42E−29 | 564 | 1120 |
| Gm03:4230665 | A | 114:0, 0:12 | 1.000, 0.000 | 126 | 3.07E−29 | 565 | 1121 |
| Gm03:4230768 | C | 114:0, 0:10 | 1.000, 0.000 | 124 | 8.42E−29 | 566 | 1122 |
| Gm03:4231904 | G | 114:0, 0:10 | 1.000, 0.000 | 124 | 8.42E−29 | 567 | 1123 |
| Gm03:4231979 | G | 114:0, 0:10 | 1.000, 0.000 | 124 | 8.42E−29 | 568 | 1124 |
| Gm03:4233068 | T | 114:0, 0:10 | 1.000, 0.000 | 124 | 8.42E−29 | 569 | 1125 |
| Gm03:4233431 | G | 114:0, 0:10 | 1.000, 0.000 | 124 | 8.42E−29 | 570 | 1126 |
| Gm03:4233493 | G | 114:0, 0:10 | 1.000, 0.000 | 124 | 8.42E−29 | 571 | 1127 |
| Gm03:4233550 | T | 114:0, 0:10 | 1.000, 0.000 | 124 | 8.42E−29 | 572 | 1128 |
| Gm03:4234109 | C | 114:0, 0:10 | 1.000, 0.000 | 124 | 8.42E−29 | 573 | 1129 |
| Gm03:4234194 | A | 114:0, 0:10 | 1.000, 0.000 | 124 | 8.42E−29 | 574 | 1130 |
| Gm03:4234277 | A | 114:0, 0:10 | 1.000, 0.000 | 124 | 8.42E−29 | 575 | 1131 |
| Gm03:4234310 | T | 114:0, 0:10 | 1.000, 0.000 | 124 | 8.42E−29 | 576 | 1132 |
| Gm03:4235089 | G | 114:0, 0:10 | 1.000, 0.000 | 124 | 8.42E−29 | 577 | 1133 |
| Gm03:4235183 | T | 114:0, 0:10 | 1.000, 0.000 | 124 | 8.42E−29 | 578 | 1134 |
| Gm03:4235519 | T | 114:0, 0:10 | 1.000, 0.000 | 124 | 8.42E−29 | 579 | 1135 |
| Gm03:4235634 | A | 114:0, 0:10 | 1.000, 0.000 | 124 | 8.42E−29 | 580 | 1136 |
| Gm03:4235844 | G | 114:0, 0:10 | 1.000, 0.000 | 124 | 8.42E−29 | 581 | 1137 |
| Gm03:4236123 | T | 114:0, 0:10 | 1.000, 0.000 | 124 | 8.42E−29 | 582 | 1138 |
| Gm03:4236298 | C | 114:0, 0:10 | 1.000, 0.000 | 124 | 8.42E−29 | 583 | 1139 |
| Gm03:4239026 | T | 114:0, 0:10 | 1.000, 0.000 | 124 | 8.42E−29 | 584 | 1140 |
| Gm03:4242434 | G | 114:0, 0:10 | 1.000, 0.000 | 124 | 8.42E−29 | 585 | 1141 |
| Gm03:4243529 | C | 114:0, 0:10 | 1.000, 0.000 | 124 | 8.42E−29 | 586 | 1142 |
| Gm03:4244201 | T | 114:0, 0:10 | 1.000, 0.000 | 124 | 8.42E−29 | 587 | 1143 |
| Gm03:4244338 | A | 114:0, 0:10 | 1.000, 0.000 | 124 | 8.42E−29 | 588 | 1144 |
| Gm03:4244497 | T | 114:0, 0:10 | 1.000, 0.000 | 124 | 8.42E−29 | 589 | 1145 |
| Gm03:4245348 | G | 114:0, 0:10 | 1.000, 0.000 | 124 | 8.42E−29 | 590 | 1146 |
| Gm03:4245390 | T | 114:0, 0:10 | 1.000, 0.000 | 124 | 8.42E−29 | 591 | 1147 |
| Gm03:4245678 | A | 114:0, 0:10 | 1.000, 0.000 | 124 | 8.42E−29 | 592 | 1148 |
| Gm03:4246770 | A | 114:0, 0:10 | 1.000, 0.000 | 124 | 8.42E−29 | 593 | 1149 |
| Gm03:4246837 | T | 114:0, 0:10 | 1.000, 0.000 | 124 | 8.42E−29 | 594 | 1150 |
| Gm03:4247592 | A | 114:0, 0:10 | 1.000, 0.000 | 124 | 8.42E−29 | 595 | 1151 |
| Gm03:4247726 | C | 114:0, 0:10 | 1.000, 0.000 | 124 | 8.42E−29 | 596 | 1152 |
| Gm03:4252413 | A | 114:0, 0:10 | 1.000, 0.000 | 124 | 8.42E−29 | 597 | 1153 |
| Gm03:4252569 | G | 114:0, 0:10 | 1.000, 0.000 | 124 | 8.42E−29 | 598 | 1154 |
| Gm03:4252894 | G | 114:0, 0:10 | 1.000, 0.000 | 124 | 8.42E−29 | 599 | 1155 |
| Gm03:4252928 | G | 114:0, 0:10 | 1.000, 0.000 | 124 | 8.42E−29 | 600 | 1156 |
| Gm03:4253518 | T | 114:0, 0:10 | 1.000, 0.000 | 124 | 8.42E−29 | 601 | 1157 |
| Gm03:4257596 | A | 114:0, 0:10 | 1.000, 0.000 | 124 | 8.42E−29 | 1377 | 1378 |
| Gm03:4257995 | G | 114:0, 0:10 | 1.000, 0.000 | 124 | 8.42E−29 | 602 | 1158 |
| Gm03:4258161 | T | 114:0, 0:12 | 1.000, 0.000 | 126 | 3.07E−29 | 603 | 1159 |
| Gm03:4258545 | T | 114:0, 0:8 | 1.000, 0.000 | 122 | 2.31E−28 | 604 | 1160 |
| Gm03:4260785 | A | 114:0, 0:8 | 1.000, 0.000 | 122 | 2.31E−28 | 605 | 1161 |
| Gm03:4260901 | C | 114:0, 0:10 | 1.000, 0.000 | 124 | 8.42E−29 | 606 | 1162 |
| Gm03:4261372 | T | 114:0, 0:8 | 1.000, 0.000 | 122 | 2.31E−28 | 607 | 1163 |
| Gm03:4261626 | A | 114:0, 0:10 | 1.000, 0.000 | 124 | 8.42E−29 | 608 | 1164 |
| Gm03:4262516 | C | 114:0, 0:10 | 1.000, 0.000 | 124 | 8.42E−29 | 609 | 1165 |
| Gm03:4262869 | G | 114:0, 0:10 | 1.000, 0.000 | 124 | 8.42E−29 | 610 | 1166 |
| Gm03:4263876 | A | 114:0, 0:10 | 1.000, 0.000 | 124 | 8.42E−29 | 611 | 1167 |
| Gm03:4264709 | C | 114:0, 0:10 | 1.000, 0.000 | 124 | 8.42E−29 | 612 | 1168 |
| Gm03:4265916 | A | 114:0, 0:10 | 1.000, 0.000 | 124 | 8.42E−29 | 613 | 1169 |
| Gm03:4266927 | A | 114:0, 0:10 | 1.000, 0.000 | 124 | 8.42E−29 | 614 | 1170 |
| Gm03:4267296 | A | 114:0, 0:8 | 1.000, 0.000 | 122 | 2.31E−28 | 615 | 1171 |
| Gm03:4268640 | C | 114:0, 0:14 | 1.000, 0.000 | 128 | 1.12E−29 | 616 | 1172 |
| Gm03:4268852 | G | 114:0, 0:6 | 1.000, 0.000 | 120 | 6.33E−28 | 617 | 1173 |
| Gm03:4295832 | A | 114:0, 0:10 | 1.000, 0.000 | 124 | 8.42E−29 | 618 | 1174 |
| Gm03:4302907 | G | 114:0, 0:12 | 1.000, 0.000 | 126 | 3.07E−29 | 619 | 1175 |
| Gm03:4302936 | A | 114:0, 0:8 | 1.000, 0.000 | 122 | 2.31E−28 | 620 | 1176 |
| Gm03:4306709 | T | 114:0, 0:10 | 1.000, 0.000 | 124 | 8.42E−29 | 621 | 1177 |
| Gm03:4307835 | C | 114:0, 0:10 | 1.000, 0.000 | 124 | 8.42E−29 | 622 | 1178 |
| Gm03:4307996 | G | 114:0, 0:12 | 1.000, 0.000 | 126 | 3.07E−29 | 623 | 1179 |

TABLE 9-continued

| Name | Assoc Allele | Case, Control Ratio Counts | Case, Control Frequencies | Chi Square | P-value | Ref. Sequence SEQ ID NO (Res.) | Ref. Sequence SEQ ID NO (Sus.) |
|---|---|---|---|---|---|---|---|
| Gm03:4308161 | T | 114:0, 0:8 | 1.000, 0.000 | 122 | 2.31E−28 | 624 | 1180 |
| Gm03:4308286 | C | 114:0, 0:8 | 1.000, 0.000 | 122 | 2.31E−28 | 625 | 1181 |
| Gm03:4308323 | G | 114:0, 0:8 | 1.000, 0.000 | 122 | 2.31E−28 | 626 | 1182 |
| Gm03:4308522 | T | 114:0, 0:16 | 1.000, 0.000 | 130 | 4.10E−30 | 627 | 1183 |
| Gm03:4313900 | C | 114:0, 0:14 | 1.000, 0.000 | 128 | 1.12E−29 | 628 | 1184 |
| Gm03:4314212 | G | 114:0, 0:8 | 1.000, 0.000 | 122 | 2.31E−28 | 629 | 1185 |
| Gm03:4314464 | G | 114:0, 0:12 | 1.000, 0.000 | 126 | 3.07E−29 | 630 | 1186 |
| Gm03:4315256 | A | 114:0, 0:6 | 1.000, 0.000 | 120 | 6.33E−28 | 631 | 1187 |
| Gm03:4317574 | G | 114:0, 0:16 | 1.000, 0.000 | 130 | 4.10E−30 | 632 | 1188 |
| Gm03:4318530 | A | 114:0, 0:8 | 1.000, 0.000 | 122 | 2.31E−28 | 633 | 1189 |
| Gm03:4319271 | C | 114:0, 0:10 | 1.000, 0.000 | 124 | 8.42E−29 | 634 | 1190 |
| Gm03:4320841 | A | 114:0, 0:10 | 1.000, 0.000 | 124 | 8.42E−29 | 635 | 1191 |
| Gm03:4321243 | C | 114:0, 0:8 | 1.000, 0.000 | 122 | 2.31E−28 | 636 | 1192 |
| Gm03:4321515 | T | 114:0, 0:6 | 1.000, 0.000 | 120 | 6.33E−28 | 637 | 1193 |
| Gm03:4328502 | G | 114:0, 0:8 | 1.000, 0.000 | 122 | 2.31E−28 | 638 | 1194 |
| Gm03:4329219 | C | 112:0, 0:6 | 1.000, 0.000 | 118 | 1.73E−27 | 639 | 1195 |
| Gm03:4329504 | T | 112:0, 0:6 | 1.000, 0.000 | 118 | 1.73E−27 | 640 | 1196 |
| Gm03:4330121 | A | 112:0, 0:6 | 1.000, 0.000 | 118 | 1.73E−27 | 641 | 1197 |
| Gm03:4330318 | T | 114:0, 0:10 | 1.000, 0.000 | 124 | 8.42E−29 | 642 | 1198 |
| Gm03:4331246 | A | 112:0, 0:6 | 1.000, 0.000 | 118 | 1.73E−27 | 643 | 1199 |
| Gm03:4331889 | A | 110:0, 0:12 | 1.000, 0.000 | 122 | 2.31E−28 | 644 | 1200 |
| Gm03:4337173 | G | 114:0, 0:8 | 1.000, 0.000 | 122 | 2.31E−28 | 645 | 1201 |
| Gm03:4338377 | G | 112:0, 0:6 | 1.000, 0.000 | 118 | 1.73E−27 | 646 | 1202 |
| Gm03:4338505 | A | 114:0, 0:8 | 1.000, 0.000 | 122 | 2.31E−28 | 647 | 1203 |
| Gm03:4338559 | T | 114:0, 0:10 | 1.000, 0.000 | 124 | 8.42E−29 | 648 | 1204 |
| Gm03:4339885 | T | 114:0, 0:14 | 1.000, 0.000 | 128 | 1.12E−29 | 649 | 1205 |
| Gm03:4341064 | A | 112:0, 0:14 | 1.000, 0.000 | 126 | 3.07E−29 | 650 | 1206 |
| Gm03:4342692 | T | 110:0, 0:8 | 1.000, 0.000 | 118 | 1.73E−27 | 651 | 1207 |
| Gm03:4342727 | A | 112:0, 0:12 | 1.000, 0.000 | 124 | 8.42E−29 | 652 | 1208 |
| Gm03:4343201 | A | 112:0, 0:12 | 1.000, 0.000 | 124 | 8.42E−29 | 653 | 1209 |
| Gm03:4343212 | T | 112:0, 0:8 | 1.000, 0.000 | 120 | 6.33E−28 | 654 | 1210 |
| Gm03:4348211 | T | 112:0, 0:6 | 1.000, 0.000 | 118 | 1.73E−27 | 655 | 1211 |
| Gm03:4350556 | A | 114:0, 0:10 | 1.000, 0.000 | 124 | 8.42E−29 | 656 | 1212 |
| Gm03:4350658 | A | 110:0, 0:10 | 1.000, 0.000 | 120 | 6.33E−28 | 657 | 1213 |
| Gm03:4350767 | G | 114:0, 0:10 | 1.000, 0.000 | 124 | 8.42E−29 | 658 | 1214 |
| Gm03:4351326 | T | 110:0, 0:10 | 1.000, 0.000 | 120 | 6.33E−28 | 659 | 1215 |
| Gm03:4351612 | T | 112:0, 0:12 | 1.000, 0.000 | 124 | 8.42E−29 | 660 | 1216 |
| Gm03:4351617 | T | 112:0, 0:6 | 1.000, 0.000 | 118 | 1.73E−27 | 661 | 1217 |
| Gm03:4351674 | A | 114:0, 0:6 | 1.000, 0.000 | 120 | 6.33E−28 | 662 | 1218 |
| Gm03:4352353 | T | 112:0, 0:8 | 1.000, 0.000 | 120 | 6.33E−28 | 663 | 1219 |
| Gm03:4353932 | T | 112:0, 0:8 | 1.000, 0.000 | 120 | 6.33E−28 | 664 | 1220 |
| Gm03:4354036 | C | 112:0, 0:6 | 1.000, 0.000 | 118 | 1.73E−27 | 665 | 1221 |
| Gm03:4355046 | C | 112:0, 0:8 | 1.000, 0.000 | 120 | 6.33E−28 | 666 | 1222 |
| Gm03:4362911 | A | 114:0, 0:12 | 1.000, 0.000 | 126 | 3.07E−29 | 667 | 1223 |
| Gm03:4363385 | A | 114:0, 0:12 | 1.000, 0.000 | 126 | 3.07E−29 | 668 | 1224 |
| Gm03:4363855 | T | 114:0, 0:16 | 1.000, 0.000 | 130 | 4.10E−30 | 669 | 1225 |
| Gm03:4364133 | A | 114:0, 0:16 | 1.000, 0.000 | 130 | 4.10E−30 | 670 | 1226 |
| Gm03:4364176 | G | 114:0, 0:18 | 1.000, 0.000 | 132 | 1.50E−30 | 671 | 1227 |
| Gm03:4364200 | A | 114:0, 0:18 | 1.000, 0.000 | 132 | 1.50E−30 | 672 | 1228 |
| Gm03:4364469 | A | 114:0, 0:12 | 1.000, 0.000 | 126 | 3.07E−29 | 673 | 1229 |
| Gm03:4385480 | G | 114:0, 0:12 | 1.000, 0.000 | 126 | 3.07E−29 | 674 | 1230 |
| Gm03:4385781 | A | 114:0, 0:14 | 1.000, 0.000 | 128 | 1.12E−29 | 675 | 1231 |
| Gm03:4386327 | A | 114:0, 0:12 | 1.000, 0.000 | 126 | 3.07E−29 | 676 | 1232 |
| Gm03:4386398 | G | 114:0, 0:12 | 1.000, 0.000 | 126 | 3.07E−29 | 677 | 1233 |
| Gm03:4386633 | G | 114:0, 0:8 | 1.000, 0.000 | 122 | 2.31E−28 | 678 | 1234 |
| Gm03:4386927 | C | 114:0, 0:8 | 1.000, 0.000 | 122 | 2.31E−28 | 679 | 1235 |
| Gm03:4387264 | T | 114:0, 0:12 | 1.000, 0.000 | 126 | 3.07E−29 | 680 | 1236 |
| Gm03:4388736 | A | 114:0, 0:14 | 1.000, 0.000 | 128 | 1.12E−29 | 681 | 1237 |
| Gm03:4388954 | T | 114:0, 0:12 | 1.000, 0.000 | 126 | 3.07E−29 | 682 | 1238 |
| Gm03:4388982 | A | 114:0, 0:16 | 1.000, 0.000 | 130 | 4.10E−30 | 683 | 1239 |
| Gm03:4389208 | T | 114:0, 0:14 | 1.000, 0.000 | 128 | 1.12E−29 | 684 | 1240 |
| Gm03:4389211 | A | 114:0, 0:14 | 1.000, 0.000 | 128 | 1.12E−29 | 685 | 1241 |
| Gm03:4389280 | A | 114:0, 0:18 | 1.000, 0.000 | 132 | 1.50E−30 | 686 | 1242 |
| Gm03:4389696 | T | 114:0, 0:12 | 1.000, 0.000 | 126 | 3.07E−29 | 687 | 1243 |
| Gm03:4390074 | G | 114:0, 0:4 | 1.000, 0.000 | 118 | 1.73E−27 | 1379 | 1380 |
| Gm03:4390738 | A | 114:0, 0:10 | 1.000, 0.000 | 124 | 8.42E−29 | 688 | 1244 |
| Gm03:4390827 | C | 114:0, 0:8 | 1.000, 0.000 | 122 | 2.31E−28 | 689 | 1245 |
| Gm03:4390979 | C | 114:0, 0:4 | 1.000, 0.000 | 118 | 1.73E−27 | 690 | 1246 |
| Gm03:4392217 | A | 114:0, 0:10 | 1.000, 0.000 | 124 | 8.42E−29 | 1381 | 1382 |
| Gm03:4392314 | C | 114:0, 0:12 | 1.000, 0.000 | 126 | 3.07E−29 | 691 | 1247 |
| Gm03:4392891 | G | 114:0, 0:12 | 1.000, 0.000 | 126 | 3.07E−29 | 692 | 1248 |
| Gm03:4392913 | G | 114:0, 0:8 | 1.000, 0.000 | 122 | 2.31E−28 | 693 | 1249 |
| Gm03:4394477 | C | 114:0, 0:12 | 1.000, 0.000 | 126 | 3.07E−29 | 1383 | 1384 |
| Gm03:4394831 | A | 114:0, 0:10 | 1.000, 0.000 | 124 | 8.42E−29 | 694 | 1250 |
| Gm03:4395386 | T | 114:0, 0:10 | 1.000, 0.000 | 124 | 8.42E−29 | 695 | 1251 |

TABLE 9-continued

| Name | Assoc Allele | Case, Control Ratio Counts | Case, Control Frequencies | Chi Square | P-value | Ref. Sequence SEQ ID NO (Res.) | Ref. Sequence SEQ ID NO (Sus.) |
|---|---|---|---|---|---|---|---|
| Gm03:4395962 | A | 112:0, 0:6 | 1.000, 0.000 | 118 | 1.73E−27 | 696 | 1252 |
| Gm03:4397872 | A | 114:0, 0:8 | 1.000, 0.000 | 122 | 2.31E−28 | 697 | 1253 |
| Gm03:4398299 | A | 114:0, 0:10 | 1.000, 0.000 | 124 | 8.42E−29 | 698 | 1254 |
| Gm03:4398919 | T | 114:0, 0:6 | 1.000, 0.000 | 120 | 6.33E−28 | 699 | 1255 |
| Gm03:4399399 | G | 114:0, 0:6 | 1.000, 0.000 | 120 | 6.33E−28 | 700 | 1256 |
| Gm03:4400461 | C | 114:0, 0:10 | 1.000, 0.000 | 124 | 8.42E−29 | 701 | 1257 |
| Gm03:4404444 | C | 114:0, 0:14 | 1.000, 0.000 | 128 | 1.12E−29 | 702 | 1258 |
| Gm03:4410393 | A | 114:0, 0:10 | 1.000, 0.000 | 124 | 8.42E−29 | 703 | 1259 |
| Gm03:4410565 | T | 114:0, 0:10 | 1.000, 0.000 | 124 | 8.42E−29 | 704 | 1260 |
| Gm03:4411187 | T | 114:0, 0:10 | 1.000, 0.000 | 124 | 8.42E−29 | 705 | 1261 |
| Gm03:4412149 | A | 114:0, 0:10 | 1.000, 0.000 | 124 | 8.42E−29 | 706 | 1262 |
| Gm03:4412417 | A | 114:0, 0:10 | 1.000, 0.000 | 124 | 8.42E−29 | 707 | 1263 |
| Gm03:4412774 | A | 114:0, 0:10 | 1.000, 0.000 | 124 | 8.42E−29 | 708 | 1264 |
| Gm03:4413415 | C | 114:0, 0:10 | 1.000, 0.000 | 124 | 8.42E−29 | 709 | 1265 |
| Gm03:4446891 | T | 112:0, 0:6 | 1.000, 0.000 | 118 | 1.73E−27 | 710 | 1266 |
| Gm03:4447988 | A | 112:0, 0:6 | 1.000, 0.000 | 118 | 1.73E−27 | 711 | 1267 |
| Gm03:4448825 | C | 114:0, 0:6 | 1.000, 0.000 | 120 | 6.33E−28 | 712 | 1268 |
| Gm03:4449634 | T | 114:0, 0:18 | 1.000, 0.000 | 132 | 1.50E−30 | 713 | 1269 |
| Gm03:4449956 | T | 112:0, 0:18 | 1.000, 0.000 | 130 | 4.10E−30 | 714 | 1270 |
| Gm03:4450328 | C | 114:0, 0:6 | 1.000, 0.000 | 120 | 6.33E−28 | 715 | 1271 |
| Gm03:4450331 | G | 114:0, 0:6 | 1.000, 0.000 | 120 | 6.33E−28 | 716 | 1272 |
| Gm03:4450888 | T | 114:0, 0:18 | 1.000, 0.000 | 132 | 1.50E−30 | 717 | 1273 |
| Gm03:4451295 | A | 114:0, 0:14 | 1.000, 0.000 | 128 | 1.12E−29 | 1385 | 1386 |
| Gm03:4451491 | A | 114:0, 0:8 | 1.000, 0.000 | 122 | 2.31E−28 | 718 | 1274 |
| Gm03:4451503 | T | 114:0, 0:16 | 1.000, 0.000 | 130 | 4.10E−30 | 719 | 1275 |
| Gm03:4451847 | T | 114:0, 0:18 | 1.000, 0.000 | 132 | 1.50E−30 | 1387 | 1388 |
| Gm03:4452060 | A | 114:0, 0:12 | 1.000, 0.000 | 126 | 3.07E−29 | 720 | 1276 |
| Gm03:4452118 | A | 114:0, 0:10 | 1.000, 0.000 | 124 | 8.42E−29 | 721 | 1277 |
| Gm03:4452820 | T | 114:0, 0:14 | 1.000, 0.000 | 128 | 1.12E−29 | 1389 | 1390 |
| Gm03:4456305 | T | 114:0, 0:16 | 1.000, 0.000 | 130 | 4.10E−30 | 722 | 1278 |
| Gm03:4458273 | G | 114:0, 0:18 | 1.000, 0.000 | 132 | 1.50E−30 | 723 | 1279 |
| Gm03:4458399 | A | 114:0, 0:18 | 1.000, 0.000 | 132 | 1.50E−30 | 724 | 1280 |
| Gm03:4461465 | T | 114:0, 0:18 | 1.000, 0.000 | 132 | 1.50E−30 | 725 | 1281 |
| Gm03:4462225 | A | 114:0, 0:18 | 1.000, 0.000 | 132 | 1.50E−30 | 726 | 1282 |
| Gm03:4471412 | T | 112:0, 0:8 | 1.000, 0.000 | 120 | 6.33E−28 | 1391 | 1392 |
| Gm03:4474352 | A | 112:0, 0:8 | 1.000, 0.000 | 120 | 6.33E−28 | 1393 | 1394 |
| Gm03:4477946 | A | 112:0, 0:6 | 1.000, 0.000 | 118 | 1.73E−27 | 727 | 1283 |
| Gm03:4477947 | C | 112:0, 0:6 | 1.000, 0.000 | 118 | 1.73E−27 | 728 | 1284 |
| Gm03:4478247 | C | 112:0, 0:6 | 1.000, 0.000 | 118 | 1.73E−27 | 729 | 1285 |
| Gm03:4478479 | G | 112:0, 0:8 | 1.000, 0.000 | 120 | 6.33E−28 | 730 | 1286 |
| Gm03:4478554 | A | 112:0, 0:10 | 1.000, 0.000 | 122 | 2.31E−28 | 731 | 1287 |
| Gm03:4478921 | A | 112:0, 0:6 | 1.000, 0.000 | 118 | 1.73E−27 | 732 | 1288 |
| Gm03:4479127 | T | 112:0, 0:6 | 1.000, 0.000 | 118 | 1.73E−27 | 733 | 1289 |
| Gm03:4506056 | A | 112:0, 0:6 | 1.000, 0.000 | 118 | 1.73E−27 | 734 | 1290 |
| Gm03:4506139 | A | 112:0, 0:6 | 1.000, 0.000 | 118 | 1.73E−27 | 735 | 1291 |
| Gm03:4506147 | T | 112:0, 0:6 | 1.000, 0.000 | 118 | 1.73E−27 | 736 | 1292 |
| Gm03:4507198 | A | 112:0, 0:8 | 1.000, 0.000 | 120 | 6.33E−28 | 737 | 1293 |
| Gm03:4525141 | A | 112:0, 0:16 | 1.000, 0.000 | 128 | 1.12E−29 | 738 | 1294 |
| Gm03:4525736 | C | 112:0, 0:14 | 1.000, 0.000 | 126 | 3.07E−29 | 739 | 1295 |
| Gm03:4526278 | C | 110:0, 0:14 | 1.000, 0.000 | 124 | 8.42E−29 | 740 | 1296 |
| Gm03:4526393 | C | 112:0, 0:16 | 1.000, 0.000 | 128 | 1.12E−29 | 741 | 1297 |
| Gm03:4526446 | G | 112:0, 0:16 | 1.000, 0.000 | 128 | 1.12E−29 | 742 | 1298 |
| Gm03:4527054 | A | 112:0, 0:16 | 1.000, 0.000 | 128 | 1.12E−29 | 743 | 1299 |
| Gm03:4533559 | A | 112:0, 0:14 | 1.000, 0.000 | 126 | 3.07E−29 | 744 | 1300 |
| Gm03:4539866 | A | 112:0, 0:12 | 1.000, 0.000 | 124 | 8.42E−29 | 745 | 1301 |
| Gm03:4541294 | A | 112:0, 0:6 | 1.000, 0.000 | 118 | 1.73E−27 | 746 | 1302 |

Example 2

Marker Loci Associated with *Phytophthora* Tolerance—Rps2 Locus

Markers were developed to characterize, identify, and/or select resistant or susceptible alleles at the Rps2 locus on linkage group J (ch 16). Markers were screened against various known resistant and susceptible parents.

Markers to loci S06862, S06863, S06864, S06865, S11652-1 and S11682-1 were developed and validated for their ability to identify the allele(s) associated with resistance at Rps2, for example alleles derived from resistant line L76-1988. Marker S06862 appeared to be within a region which is deleted in some lines, and did not amplify in several geneotypes. Therefore, genomic regions outside of the apparent deletion were targeted for marker development by sequencing 1588 regions in 25 soybean lines to develop a SNP profile. Markers to S11652 and S11682 were made based on the SNP profile and were screened and verified in known resistant and susceptible varieties. Further development and testing was done to optimize markers to these for high throughput analysis of soybean.

An F2 mapping population derived from a cross of L76-1988 X susceptible consisting 256 individuals was used to fine map QTL for Rps2 on LG-J. A total of 9 polymorphic markers were utilized to construct the linkage group and perform QTL analysis. Three Rps2 phenotypic data sets were used: Score 1, Score 2, and an average score. Phenotypic distributions of all 3 datasets were consistent. A major QTL was detected on all the three data sets. The QTL was closely linked with marker S11652-1-Q1 and flanked by markers to form an interval which explained ~69% of phenotypic variation (averaged score).
Initial Map Manager Parameters were set to:
 1) Linkage Evaluation: Intercross
 2) Search Criteria: P=1e$^{-5}$
 3) Map Function: Kosambi
 4) Cross Type: Line Cross
The permutation test simulation was done for each score established significance boundaries in order to identify QTLs as follows:

|  | Rps2 Score1 | Rps2 Score2 | Rps2_Avg |
|---|---|---|---|
| Suggestive | 0.7 | 0.7 | 0.7 |
| Significant | 5.3 | 5.4 | 5.8 |
| Highly significant | 13.6 | 11.1 | 13.7 |

Markers 511652-1-Q1, 50683-1-Q1, and 511682-1-Q1 on LG J were identified as highly significant using Map ManagerQTX (Manly et al. (2001) Mammalian Genome 12:930-932) marker regression analysis of each of the 3 phenotypic datasets. Each had a p value of 0.00000, a % values from 56-68%, and stat values from 152.2-242.7 across the 3 regressions.

Example 3

Marker Loci Associated with *Phytophthora* Tolerance in Rps3 Loci

Markers were developed to characterize, identify, and/or select resistant or susceptible alleles at the Rps3 locus on linkage group F (ch 13). Markers were screened against various known resistant and susceptible varieties.

A marker to loci S07361-1, S08342-1, S09081-1 was developed to identify alleles associated with the *phytophthora* phenotype. Markers to S08342-1, S09081-1 detect res/sus polymorphisms for Rps3a, and markers to S07361-1 detect res/sus polymorphisms for Rps3c. During development, each marker was validated and confirmed against a panel of about 30 resistant and susceptible varieties which included proprietary experimental lines, proprietary commercial lines, and public lines. Further development and testing was done to optimize each marker system for high throughput analysis of soybean.

An F2:3 population 95Y40xExpSUS, segregating for *phytophthora* root rot response, was used for Rps3c marker refinement. Parental line 95Y40 carries both the Rps3c and Rps1k *phytophthora* resistance alleles, ExpSUS is a proprietary experimental line susceptible to *Phytophthora*. No significant QTLs were detected in this study. One suggestive QTL was found on each chromosome F_(13) and chromosome N_(3), however there was no significant association between the resistant phenotype and the Rps3c (S07163-1-Q3) and Rps1k (S00009-01-A) MAS markers located on the chromosomes, respectively.

The F2:3 population consisted of 90 progeny. Genomic DNA was extracted using a standard CTAB method and used for genotyping. Eight polymorphic markers were selected from LG-F, as well as 6 polymorphic markers selected from LG-N flanking and including the MAS markers S07163-1-Q1 and S00009-01-A and used to genotype the population. Phenotypic scores categorized the progeny as Resistant, Susceptible, and Heterozygous. The classes were assigned numbers 9, 1, and 5, respectively for QTL analysis. Map Manager QTX.b20 was used to construct the linkage map with the following parameters:
 1) Linkage Evaluation: Intercross
 2) Search Criteria: P=1e$^{-5}$
 3) Map Function: Kosambi
 4) Cross Type: Line Cross
Marker regression (p=0.001) and interval mapping were executed using Map Manager QTX.b20 and the results were confirmed using single marker analysis and composite interval mapping in QTL Cartographer 2.5. A permutation test was run in Map Manager 1000 times (free model), and in QTL Cartographer 500 times (p=0.5) to establish the threshold for statistical significance. Preliminary analysis indicated all 14 markers showed severe segregation distortion (chi square test statistic p=0.001) using the expected F2 segregation ratios. Instead, the observed genotypic ratios fit an F3 model well. In addition, three progeny matched parental calls across all 14 markers and were removed from subsequent analysis. The allele calls were converted to the A (maternal), B (paternal), H (heterozygous) convention for mapping analysis.

The phenotypic distribution of the 87 progeny employed in this analysis was evaluated using both percent dead scores, and the distribution after grouping into classes. In each case, the distributions were essentially normal. The resistant parent's average phenotypic score was 66% dead, placing the value near the mid-point of the population phenotypic distribution rather than the tail.

In the mapping analysis markers formed two linkage groups on LG F and LG N, with one marker remaining unlinked. Marker regression (Map Manager) and single marker analysis (QTL Cartographer) were performed, each indicating two suggestive regions of interest, a region on LG F comprising S07163-1-Q3, and a region on LG N comprising S00009-01-A. Neither reached the LRS cutoff for significance in this study.

Example 4

Marker Loci Associated with *Phytophthora* Tolerance in the Rps6 Locus

Markers were developed to characterize, identify, and/or select resistant or susceptible alleles at the Rps6 locus on linkage group G (ch 18). Markers were screened against various known resistant and susceptible parents.

A marker to locus S08442 was developed to identify alleles associated with the *phytophthora* phenotype. Sequencing was done to develop a SNP profile for marker development. During development, this marker was validated against *Phytophthora* resistant line Archer, and a susceptible line. The marker was further validated and confirmed against a panel of about 30 varieties which included proprietary experimental lines, proprietary commercial lines, and public lines. This marker was additionally used to fingerprint approximately 2000 soybean lines.

All publications and patent applications mentioned in the specification are indicative of the level of those skilled in the art to which this invention pertains. All publications and patent applications are herein incorporated by reference to the same extent as if each individual publication or patent application was specifically and individually indicated to be incorporated by reference.

Although the foregoing invention has been described in some detail by way of illustration and example for purposes of clarity of understanding, it will be obvious that certain changes and modifications may be practiced within the scope of the appended claims.

SEQUENCE LISTING (1394 sequences)

SEQ ID NO: 1 - DNA, 20 bp, Artificial Sequence
  Primer
aaaaatgcctcgtggagaga

SEQ ID NO: 2 - DNA, 28 bp, Artificial Sequence
  Primer
gaaaatatgtaaaagaagaactgccaga

SEQ ID NO: 3 - DNA, 23 bp, Artificial Sequence
  Primer
tggagagacaaaacaggagattt

SEQ ID NO: 4 - DNA, 25 bp, Artificial Sequence
  Primer
atacacaatggaagattgtttagca

SEQ ID NO: 5 - DNA, 22 bp, Artificial Sequence
  Primer
gaaagagaaactgggattctgg

SEQ ID NO: 6 - DNA, 26 bp, Artificial Sequence
  Primer
tatacacaatggaagattgtttagca

SEQ ID NO: 7 - DNA, 21 bp, Artificial Sequence
  Primer
cctcgtggagagacaaaacag

SEQ ID NO: 8 - DNA, 27 bp, Artificial Sequence
  Primer
cgagaaaatatgtaaaagaagaactgc

SEQ ID NO: 9 - DNA, 22 bp, Artificial Sequence
  Primer
agattcaaggagtccagacgat

SEQ ID NO: 10 - DNA, 18 bp, Artificial Sequence
  Primer
ctccagcgggagatttgc

SEQ ID NO: 11 - DNA, 20 bp, Artificial Sequence
  Primer
tcaaggagtccagacgatgc

SEQ ID NO: 12 - DNA, 20 bp, Artificial Sequence
  Primer
ygtcatgctcaagctgttcg

SEQ ID NO: 13 - DNA, 20 bp, Artificial Sequence
  Primer
aagctgccaagggacaatta

SEQ ID NO: 14 - DNA, 20 bp, Artificial Sequence
  Primer
cgggagatttgcttcttcaa

SEQ ID NO: 15 - DNA, 22 bp, Artificial Sequence
  Primer
caagctagtaaggccattttgc

SEQ ID NO: 16 - DNA, 22 bp, Artificial Sequence
  Primer
ctgccaagggacaattagactt

SEQ ID NO: 17 - DNA, 18 bp, Artificial Sequence
  Primer
ccagcgggagatttgctt

SEQ ID NO: 18 - DNA, 21 bp, Artificial Sequence
  Primer
attcaaggagtccagacgatg

SEQ ID NO: 19 - DNA, 23 bp, Artificial Sequence
  Primer
ctagtaaggccattttgcttcag

SEQ ID NO: 20 - DNA, 20 bp, Artificial Sequence
  Primer
cttgcattctggaggtgcta

SEQ ID NO: 21 - DNA, 20 bp, Artificial Sequence
  Primer
ccatcccctattctttggtg

SEQ ID NO: 22 - DNA, 20 bp, Artificial Sequence
  Primer
atgaggacacaatgccatga

SEQ ID NO: 23 - DNA, 20 bp, Artificial Sequence
  Primer
tgagaaggccaatcctatgc

SEQ ID NO: 24 - DNA, 21 bp, Artificial Sequence
  Primer
attttgggcaaatgatgaagc

SEQ ID NO: 25 - DNA, 23 bp, Artificial Sequence
  Primer
ctcagctaaagacaccctgcaat

SEQ ID NO: 26 - DNA, 20 bp, Artificial Sequence
  Primer
ttgggcaaatgatgaagcta

SEQ ID NO: 27 - DNA, 19 bp, Artificial Sequence
  Primer
gagggctcatcagcacaaa

SEQ ID NO: 28 - DNA, 22 bp, Artificial Sequence
  Primer
aaatggtttgtgggaggttaga

SEQ ID NO: 29 - DNA, 25 bp, Artificial Sequence
  Primer
agaataaatggtttgtgggaggtta

SEQ ID NO: 30 - DNA, 28 bp, Artificial Sequence
  Primer
tgaagatatgcaaattcttttcaaatta

SEQ ID NO: 31 - DNA, 18 bp, Artificial Sequence
  Primer
accatggagggctcatca

SEQ ID NO: 32 - DNA, 23 bp, Artificial Sequence
  Primer
ctcagctaaagacaccctgcaat

SEQ ID NO: 33 - DNA, 20 bp, Artificial Sequence
  Primer
caaaagggcatcctcaaaag

SEQ ID NO: 34 - DNA, 27 bp, Artificial Sequence
  Primer
tgggaggttagattttctgaacgaaga

SEQ ID NO: 35 - DNA, 24 bp, Artificial Sequence
  Primer
catcagcacaaaagggcatcctca

SEQ ID NO: 36 - DNA, 25 bp, Artificial Sequence
  Primer
tgacacgtggtgcgttaggaatttt

SEQ ID NO: 37 - DNA, 30 bp, Artificial Sequence
  Primer
tgaaacgcattagttcaggtggtaacttct

SEQ ID NO: 38 - DNA, 26 bp, Artificial Sequence
  Primer
gaaaacgaaaattgtaagagcaactt

SEQ ID NO: 39 - DNA, 20 bp, Artificial Sequence
  Primer
atggaatgagtttgggatgg

SEQ ID NO: 40 - DNA, 20 bp, Artificial Sequence
  Primer
ccaaagctgtcttggaggaa

SEQ ID NO: 41 - DNA, 25 bp, Artificial Sequence
  Primer
caaaacagatgcttttaacatgaac

SEQ ID NO: 42 - DNA, 21 bp, Artificial Sequence
  Primer
gctgtcttggaggaacttgaa

SEQ ID NO: 43 - DNA, 20 bp, Artificial Sequence
  Primer
tttcacaacacgaggctgtc

SEQ ID NO: 44 - DNA, 20 bp, Artificial Sequence
  Primer
gttgccaaagctgtcttgga

SEQ ID NO: 45 - DNA, 23 bp, Artificial Sequence
  Primer
cacgaggctgtctactctcttca

SEQ ID NO: 46 - DNA, 26 bp, Artificial Sequence
  Primer
tcacacaaggaaatttaacactacat

SEQ ID NO: 47 - DNA, 23 bp, Artificial Sequence
  Primer
ttctcaccttctgttgtattgga

SEQ ID NO: 48 - DNA, 20 bp, Artificial Sequence
  Primer
cgccaaatggcttacttctc

SEQ ID NO: 49 - DNA, 22 bp, Artificial Sequence
  Primer
accaatgaatcacacaaggaaa

SEQ ID NO: 50 - DNA, 18 bp, Artificial Sequence
  Primer
ggcgccaaatggcttact

SEQ ID NO: 51 - DNA, 26 bp, Artificial Sequence
  Primer
tgaatcacacaaggaaatttaacact

SEQ ID NO: 52 - DNA, 20 bp, Artificial Sequence
  Primer
aaccatgcccttgaacagtc

SEQ ID NO: 53 - DNA, 23 bp, Artificial Sequence
  Primer
tttgtgaaggacattttgatttg

SEQ ID NO: 54 - DNA, 20 bp, Artificial Sequence
  Primer
tgaacagtctgccctcagaa

SEQ ID NO: 55 - DNA, 20 bp, Artificial Sequence
  Primer
tctcaaaatcggcatgaggt

SEQ ID NO: 56 - DNA, 20 bp, Artificial Sequence
  Primer
ccttgaacagtctgccctca

SEQ ID NO: 57 - DNA, 24 bp, Artificial Sequence
  Primer
tgaactttgtgaaggacattttga

SEQ ID NO: 58 - DNA, 22 bp, Artificial Sequence
  Primer
gtttcaccaaggtaatttgcat

SEQ ID NO: 59 - DNA, 20 bp, Artificial Sequence
  Primer
tttgtgcaattctcccatca

SEQ ID NO: 60 - DNA, 23 bp, Artificial Sequence
  Primer
tgtttacacgttctccaatcaaa

SEQ ID NO: 61 - DNA, 20 bp, Artificial Sequence
  Primer
tgtgcaattctcccatcaaa

SEQ ID NO: 62 - DNA, 24 bp, Artificial Sequence
  Primer
caagtgttgtttacacgttctcca

SEQ ID NO: 63 - DNA, 21 bp, Artificial Sequence
  Primer
ttccataggtgctgtttgtgc

SEQ ID NO: 64 - DNA, 20 bp, Artificial Sequence
  Primer
tttcactgcaagagggaagg

SEQ ID NO: 65 - DNA, 20 bp, Artificial Sequence
  Primer
attcctgcagcttctccatc

SEQ ID NO: 66 - DNA, 21 bp, Artificial Sequence
  Primer
gaagggctgttggttataccg

SEQ ID NO: 67 - DNA, 25 bp, Artificial Sequence
  Primer
catcttatctttgaacctttcctga

SEQ ID NO: 68 - DNA, 18 bp, Artificial Sequence
  Primer
agggaagggctgttggtt

SEQ ID NO: 69 - DNA, 24 bp, Artificial Sequence
  Primer
tccatcttatctttgaacctttcc

SEQ ID NO: 70 - DNA, 19 bp, Artificial Sequence
  Primer
gcaagagggaagggctgtt

SEQ ID NO: 71 - DNA, 20 bp, Artificial Sequence
  Primer
acaacacctccagagcatcc

SEQ ID NO: 72 - DNA, 25 bp, Artificial Sequence
  Primer
gcttgtcaacatcatctaaaatcaa

SEQ ID NO: 73 - DNA, 21 bp, Artificial Sequence
  Primer
ggttacaacacctccagagca

SEQ ID NO: 74 - DNA, 25 bp, Artificial Sequence
  Primer
tgcttgtcaacatcatctaaaatca

SEQ ID NO: 75 - DNA, 20 bp, Artificial Sequence
  Primer
ctccagagcatccttcttcg

SEQ ID NO: 76 - DNA, 24 bp, Artificial Sequence
  Primer
tcatgcttgtcaacatcatctaaa

SEQ ID NO: 77 - DNA, 19 bp, Artificial Sequence
  Primer
caacacctccagagcatcc

SEQ ID NO: 78 - DNA, 22 bp, Artificial Sequence
  Primer
gatgatgactctactgcctgga

SEQ ID NO: 79 - DNA, 20 bp, Artificial Sequence
  Primer
aagtggcagagtgaacagca

SEQ ID NO: 80 - DNA, 20 bp, Artificial Sequence
  Primer
taagcgcattttcaaagctg

SEQ ID NO: 81 - DNA, 21 bp, Artificial Sequence
  Primer
gaccgtagagaaagtggcaga

SEQ ID NO: 82 - DNA, 22 bp, Artificial Sequence
  Primer
aataagcgcattttcaaagctg

SEQ ID NO: 83 - DNA, 21 bp, Artificial Sequence
  Primer
ggaggaaaggaccgtagagaa

SEQ ID NO: 84 - DNA, 19 bp, Artificial Sequence
  Primer
agcgcattttcaaagctga

SEQ ID NO: 85 - DNA, 22 bp, Artificial Sequence
  Primer
tgttgctcttccaaaagatgac

SEQ ID NO: 86 - DNA, 22 bp, Artificial Sequence
  Primer
tgcataacgtttcagaaggaaa

SEQ ID NO: 87 - DNA, 23 bp, Artificial Sequence
  Primer
ccagtgaactatgttgctcttcc

SEQ ID NO: 88 - DNA, 25 bp, Artificial Sequence
  Primer
ccaaatttacaatgcataacgtttc

SEQ ID NO: 89 - DNA, 38 bp, Artificial Sequence
  Primer
aaagaagtttaatttgcaaatagcttgaatttttcaaa

SEQ ID NO: 90 - DNA, 32 bp, Artificial Sequence
  Primer
tactccaatcagagtttccatggcaaagttag

SEQ ID NO: 91 - DNA, 24 bp, Artificial Sequence
  Primer
caggaaagttgaattgctttatcc

SEQ ID NO: 92 - DNA, 22 bp, Artificial Sequence
  Primer
cagagtttccatggcaaagtta

SEQ ID NO: 93 - DNA, 22 bp, Artificial Sequence
  Primer
ggccttttgttatttcttcagc

SEQ ID NO: 94 - DNA, 21 bp, Artificial Sequence
  Primer
gagtatggagacagcccacaa

SEQ ID NO: 95 - DNA, 23 bp, Artificial Sequence
  Primer
cacattataggggccttttgtta

SEQ ID NO: 96 - DNA, 21 bp, Artificial Sequence
  Primer
ttgcatattttctcccacctg

SEQ ID NO: 97 - DNA, 23 bp, Artificial Sequence
  Primer
cacattataggggccttttgtta

SEQ ID NO: 98 - DNA, 26 bp, Artificial Sequence
  Primer
ttagcttgtgtagagtatggagacag

SEQ ID NO: 99 - DNA, 22 bp, Artificial Sequence
  Primer
aggggccttttgttatttcttc

SEQ ID NO: 100 - DNA, 20 bp, Artificial Sequence
  Primer
tttctcccacctgtgcattt

SEQ ID NO: 101 - DNA, 20 bp, Artificial Sequence
  Primer
cgtccgagattggaaattgt

SEQ ID NO: 102 - DNA, 21 bp, Artificial Sequence
  Primer
tggactttggaattgaaccag

SEQ ID NO: 103 - DNA, 23 bp, Artificial Sequence
  Primer
tgtgagacaaactcctgcataaa

SEQ ID NO: 104 - DNA, 24 bp, Artificial Sequence
  Primer
ttattgtgagacaaactcctgcat

SEQ ID NO: 105 - DNA, 17 bp, Artificial Sequence
  Probe
cctcacatacacatcag

SEQ ID NO: 106 - DNA, 17 bp, Artificial Sequence
  Probe
cctcacatacacattag

SEQ ID NO: 107 - DNA, 17 bp, Artificial Sequence
  Probe
acatacacatcagcaac

SEQ ID NO: 108 - DNA, 15 bp, Artificial Sequence
  Probe
acacattagcaaccc

SEQ ID NO: 109 - DNA, 17 bp, Artificial Sequence
  Probe
tcacatacacatcagca

SEQ ID NO: 110 - DNA, 17 bp, Artificial Sequence
  Probe
tcacatacacattagca

SEQ ID NO: 111 - DNA, 16 bp, Artificial Sequence
  Probe
ttgccaacctgataga

SEQ ID NO: 112 - DNA, 15 bp, Artificial Sequence
  Probe
ccaacctgatcgaga

SEQ ID NO: 113 - DNA, 17 bp, Artificial Sequence
  Probe
ttctctatcaggttggc

SEQ ID NO: 114 - DNA, 17 bp, Artificial Sequence
  Probe
ttgcacatcttctcgat

SEQ ID NO: 115 - DNA, 14 bp, Artificial Sequence
  Probe
ttccctgtgtttgc

SEQ ID NO: 116 - DNA, 14 bp, Artificial Sequence
  Probe
ttccctgcgtttgc

SEQ ID NO: 117 - DNA, 16 bp, Artificial Sequence
  Probe
ccagatcatatatcgc

SEQ ID NO: 118 - DNA, 15 bp, Artificial Sequence
  Probe
cagatcacatatcgc

SEQ ID NO: 119 - DNA, 17 bp, Artificial Sequence
  Probe
ctccttaaggtaattaa

SEQ ID NO: 120 - DNA, 17 bp, Artificial Sequence
  Probe
agcactccttaagataa

SEQ ID NO: 121 - DNA, 16 bp, Artificial Sequence
  Probe
cactccttaaggtaat

SEQ ID NO: 122 - DNA, 16 bp, Artificial Sequence
  Probe
cactccttaagataat

SEQ ID NO: 123 - DNA, 17 bp, Artificial Sequence
  Probe
agcactccttaagataa

SEQ ID NO: 124 - DNA, 15 bp, Artificial Sequence
  Probe
catgtggctcaattt

SEQ ID NO: 125 - DNA, 15 bp, Artificial Sequence
  Probe
catgtggcttaattt

SEQ ID NO: 126 - DNA, 19 bp, Artificial Sequence
  Probe
tcatcttttcatccagtgc

SEQ ID NO: 127 - DNA, 19 bp, Artificial Sequence
  Probe
atcttttcattcagtgcat

SEQ ID NO: 128 - DNA, 18 bp, Artificial Sequence
  Probe
cttacttttgcacatgta

SEQ ID NO: 129 - DNA, 17 bp, Artificial Sequence
  Probe
tagcttgttggttgcac

SEQ ID NO: 130 - DNA, 16 bp, Artificial Sequence
  Probe
tttggaactgcacctc

SEQ ID NO: 131 - DNA, 17 bp, Artificial Sequence
  Probe
tttggaattgcacctca

SEQ ID NO: 132 - DNA, 18 bp, Artificial Sequence
  Probe
ctgctgtactaatcatat

SEQ ID NO: 133 - DNA, 18 bp, Artificial Sequence
  Probe
ctgctgtactagtcatat

SEQ ID NO: 134 - DNA, 18 bp, Artificial Sequence
  Probe
atgcaaatttctatcttg

SEQ ID NO: 135 - DNA, 19 bp, Artificial Sequence
  Probe
atgcaaatttttatcttgc

SEQ ID NO: 136 - DNA, 15 bp, Artificial Sequence
  Probe
caaagtcgatccttc

SEQ ID NO: 137 - DNA, 19 bp, Artificial Sequence
  Probe
cttttacaaagtagatcct

SEQ ID NO: 138 - DNA, 14 bp, Artificial Sequence
  Probe
caacatcggcttca

SEQ ID NO: 139 - DNA, 15 bp, Artificial Sequence
  Probe
acaacataggcttca

SEQ ID NO: 140 - DNA, 19 bp, Artificial Sequence
  Probe
ctaatttgactcctgaatc

SEQ ID NO: 141 - DNA, 19 bp, Artificial Sequence
  Probe
ctaatttgactcgtgaatc

SEQ ID NO: 142 - DNA, 16 bp, Artificial Sequence
  Probe
accatactaaaaaatt

SEQ ID NO: 143 - DNA, 15 bp, Artificial Sequence
  Probe
accatactcaaaaat

SEQ ID NO: 144 - DNA, 14 bp, Artificial Sequence
  Probe
ggaacgttaccgga

SEQ ID NO: 145 - DNA, 16 bp, Artificial Sequence
  Probe
tggaacattaccggac

SEQ ID NO: 146 - DNA, 15 bp, Artificial Sequence
  Probe
tgggtccggtaacgt

SEQ ID NO: 147 - DNA, 14 bp, Artificial Sequence
  Probe
tccggtaatgttcc

SEQ ID NO: 148 - DNA, 16 bp, Artificial Sequence
  Probe
tggaacgttaccggac

SEQ ID NO: 149 - DNA, 14 bp, Artificial Sequence
  Probe
cgtggaacattacc

SEQ ID NO: 150 - DNA, 18 bp, Artificial Sequence
  Probe
caaattaacacatcaaca

SEQ ID NO: 151 - DNA, 18 bp, Artificial Sequence
  Probe
caaattaacacgtcaaca

SEQ ID NO: 152 - DNA, 19 bp, Artificial Sequence
  Probe
atctttttggaagttatac

SEQ ID NO: 153 - DNA, 18 bp, Artificial Sequence
  Probe
tctttttggaagatatac

SEQ ID NO: 154 - DNA, 20 bp, Artificial Sequence
  Probe
catctttttggaatatatac

SEQ ID NO: 155 - DNA, 692 bp, Artificial Sequence
  Consensus Reference Sequence
tysrwaatggggccacccatattattttgctaccgaaatagaatacgaaaatgggggtagtgaccttrtggccatagagttgaagcaagctaattctgacwcgtggcttcccatgcagcgttcatggggtgcaaggtgggctttgaatttaggtttacaattacaagcaccattatctattaagctcacagaacaaggcaagggctattacaagacaattgtggctgatagtgtaattccacatggctggcaacctggccaagtttatcgatctgttgttaatttttaaactctgtttaaaatcatgacatcaatcgagaaaatatgtaaaagaagaactgccagattatataaataagtttatccttgtcagttcatatatatatacacaatggaagattgtttagcaatawttctttgcatttcttttatgtgataaaaagtatgtgtaataatatgggggttgctgatgtgtatgtgaggttgtgaaactttgtttttaaataaaaataattcaaatctcctgttttgtctctccacgaggcattttttcctaataayccagaatcccagtttctctttcccrtgaacacttccttcttcttggtttgcagttttttaaaataaaaggttattattttctataaaaaaaatgaaaagcaatcacctgcaagacatggtcatagcckktt

SEQ ID NO: 156 - DNA, 692 bp, Artificial Sequence
  Consensus Reference Sequence
tysrwaatggggccacccatattattttgctaccgaaatagaatacgaaaatgggggtagtgaccttrtggccatagagttgaagcaagctaattctgacwcgtggcttcccatgcagcgttcatggggtgcaaggtgggctttgaatttaggtttacaattacaagcaccattatctattaagctcacagaacaaggcaagggctattacaagacaattgtggctgatagtgtaattccacatggctggcaacctggccaagtttatcgatctgttgttaatttttaaactctgtttaaaatcatgacatcaatcgagaaaatatgtaaaagaagaactgccagattatataaataagtttatccttgtcagttcatatatatatacacaatggaagattgtttagcaatawttctttgcatttcttttatgtgataaaaagtatgtgtaataatatgggggttgctaatgtgtatgtgaggttgtgaaactttgtttttaaataaaaataattcaaatctcctgttttgtctctccacgaggcattttttcctaataayccagaatcccagtttctctttcccrtgaacacttccttcttcttggtttgcagttttttaaaataaaaggttattattttctataaaaaaaatgaaaagcaatcacctgcaagacatggtcatagcckktt

SEQ ID NO: 157 - DNA, 602 bp, Artificial Sequence
  Consensus Reference Sequence
attgktkgtstgkkcctvsmyrtttgaagctgaatttgtttgctgctctgttatcaagctagtaaggccattttgcttcagrtaggtctccagcgggagatttgcttcttcaagaagactygtcatgctcaagctgttcggcccagcttgcacatcttctctatcaggttggcaattcaagtctaattgtcccttggcagcttcagccaccgcatcgtctggactccttgaatctaattcattttgcacccttacttcattctccaaaccgtcaactggagttaaatggcgagaggtgctatctacttctgattcatctttcgtccgccatgataactgatttctctgagcaatctctgcttcacgttcrgattgcygcttctyctttcgcakcatcagggttttaaaccgacgtttaactgtcatgcacacattgcaggtgcatgtaggtttgtgtttgcccttcccacttggtggctggatacaracaatgcaagagcacccaggtctatgccgaggatgttttgtggtggtaacaactggtgttctgccagagtcacttgcatcatctcccagtattgctgcatttgccatggtcatag

SEQ ID NO: 158 - DNA, 602 bp, Artificial Sequence
  Consensus Reference Sequence
attgktkgtstgkkcctvsmyrtttgaagctgaatttgtttgctgctctgttatcaagctagtaaggccattttgcttcagrtaggtctccagcgggagatttgcttcttcaagaagactygtcatgctcaagctgttcggcccagcttgcacatcttctcgatcaggttggcaattcaagtctaattgtcccttggcagcttcagccaccgcatcgtctggactccttgaatctaattcattttgcacccttacttcattctccaaaccgtcaactggagttaaatggcgagaggtgctatctacttctgattcatctttcgtccgccatgataactgatttctctgagcaatctctgcttcacgttcrgattgcygcttctyctttcgcakcatcagggttttaaaccgacgtttaactgtcatgcacacattgcaggtgcatgtaggtttgtgtttgcccttcccacttggtggctggatacaracaatgcaagagcacccaggtctatgccgaggatgttttgtggtggtaacaactggtgttctgccagagtcacttgcatcatctcccagtattgctgcatttgccatggtcatag

SEQ ID NO: 159 - DNA, 639 bp, Artificial Sequence
  Consensus Reference Sequence
gcaagcctgcttcaaggacttgcgtggtgcacgtatgaagaatagtggcgtgaatgggagctaacctggattgtgaaaatggaatacaaattgcaaaatcatcaatgatttytagaatatttcctttatacaaaatgacaaattctattattagggaagtggtataaataaaagcatttgtaaaccattgagggatatgaatgaacaaaatacaagcttcctttccttcrgtgcctttttctctcttcttcttccttgcattctggaggtgctagtcccgaatccagcaatttccctgcgtttgcacgtaacatagtttctagtattagttaaagggcaaaactaaaaaatatgtgcaccaaagaataggggatggttagtttttatgttagaatcttacgacaatttgaacctactatctcttctactttttcttttaacacttaatttttttttykatcattaaattaattttatatctttggatattttatttattattattaattattaaaagaaagwgcagagagtattgttagcatttctattataattaatctgaaattgaacaatgtatgtattcaacaaaacagtgaagcagtgaatttgaagatggaaggaatcaagaaagtacaagtg

SEQ ID NO: 160 - DNA, 639 bp, Artificial Sequence
  Consensus Reference Sequence
gcaagcctgcttcaaggacttgcgtggtgcacgtatgaagaatagtggcgtgaatgggagctaacctggattgtgaaaatggaatacaaattgcaaaatcatcaatgatttytagaatatttcctttatacaaaatgacaaattctattattagggaagtggtataaataaaagcatttgtaaaccattgagggatatgaatgaacaaaatacaagcttcctttccttcrgtgcctttttctctcttcttcttccttgcattctggaggtgctagtcccgaatccagcaatttccctgtgtttgcacgtaacatagtttctagtattagttaaagggcaaaactaaaaaatatgtgcaccaaagaataggggatggttagtttttatgttagaatcttacgacaatttgaacctactatctcttctactttttcttttaacacttaatttttttttykatcattaaattaattttatatctttggatattttatttattattattaattattaaaagaaagwgcagagagtattgttagcatttctattataattaatctgaaattgaacaatgtatgtattcaacaaaacagtgaagcagtgaatttgaagatggaaggaatcaagaaagtacaagtg

SEQ ID NO: 161 - DNA, 744 bp, Artificial Sequence
  Consensus Reference Sequence
  misc_feature 11, 19: n = A,T,C or G
ctttctyyttngcttttcngagaagaagagataagatcaaccaaagaatgaaggaattgcaaaagctggtcccaaattccagtaaggtaaagaaagaatggttgtaacttagccaagtttttggtataaaattatgttcccaatcttttttcaaattctctattatgtaagaaagtggccatacgtaacatgataaagctgcaacattgatcctctctttaatttctttccctgttcaccaattaatcggttcagtggtcccatgaggacacaatgccatgaascccagatcatcatatcgcatctccwtatagtatatgtttcattttgtgtctgcataggattggccttctcataaagcaaacgcatttcagaaatcaattggaatccttttatrtctctttgaagaacttcttaaaggaatatgtgcctaaatgacaaaattcagtttcaatctttaagtttgytcgaaataaaaaggtttcacttttgattaataattgagttactaacasaaagacaattagactctatgtctacacatcttggtgagaatcctctactgactactgataagataatacttttagatccgattgatacattgttgtagtttaattatcattctcgagtttaagtttttgatatgaattacattatattgcaaagwaaattttgtctagtattatatgattactcgawaatattaatattggagagaaaattgccyytcacatggtcata

SEQ ID NO: 162 - DNA, 743 bp, Artificial Sequence
  Consensus Reference Sequence
  misc_feature 11, 19: n = A,T,C or G
ctttctyyttngcttttcngagaagaagagataagatcaaccaaagaatgaaggaattgcaaaagctggtcccaaattccagtaaggtaaagaaagaatggttgtaacttagccaagtttttggtataaaattatgttcccaatcttttttcaaattctctattatgtaagaaagtggccatacgtaacatgataaagctgcaacattgatcctctctttaatttctttccctgttcaccaattaatcggttcagtggtcccatgaggacacaatgccatgaascccagatcacatatcgcatctccwtatagtatatgtttcattttgtgtctgcataggattggccttctcataaagcaaacgcatttcagaaatcaattggaatccttttatrtctctttgaagaacttcttaaaggaatatgtgcctaaatgacaaaattcagtttcaatctttaagtttgytcgaaataaaaaggtttcacttttgattaataattgagttactaacasaaagacaattagactctatgtctacacatcttggtgagaatcctctactgactactgataagataatacttttagatccgattgatacattgttgtagtttaattatcattctcgagtttaagtttttgatatgaattacattatattgcaaagwaaattttgtctagtattatatgattactcgawaatattaatattggagagaaaattgccyytcacatggtcata

SEQ ID NO: 163 - DNA, 777 bp, Artificial Sequence
  Consensus Reference Sequence
ctgcagtgttgtctctcggagttgcttcaattgctcatactctttgggataaccactcatttcaaagatgtactagtttaaaacatgcaaaaagataaagttaatgtgtattttgtatgttgtagggaagcacaaagtatcttgattgaattaggaagattacacgagccgtatgcatcagaataaatggtttgtgggaggttagattttctgaacgaagatgaagatatgcaaattcttttcaaattaattttgggcaaatgatgaagctagactgataattgattaattttgggcaaataatattatattacatgtatgagattgattttaagtgtatatgcatacatgaagcaatagacttaatttaattaccttaaggagtgctggacttttgaggatgcccttttgtgctgatgagccctccatggttgacatacaaagcaaattgcagggtgtctttagctgaggtttttgctgcttcgaagtggcaattgaatcagctccgttggacagtgacatggtgatggtggtgataattaattcggcttaagggtaagtacaacttcttagctctgtaagcaaaggatgccttgtggagttggttcatctaatccacgtatatatagggctgaacgagggaacaagagttttcaatcaatgattacaattccacactctcgcctctaaagtgcatccctcacattgaagcatcctccaaatcccaaaatattattattaccacttaaagctattacaaatcagaaaacactgcag

SEQ ID NO: 164 - DNA, 777 bp, Artificial Sequence
  Consensus Reference Sequence
ctgcagtgttgtctctcggagttgcttcaattgctcatactctttgggataaccactcatttcaaagatgtactagtttaaaacatgcaaaaagataaagttaatgtgtattttgtatgttgtagggaagcacaaagtatcttgattgaattaggaagattacacgagccgtatgcatcagaataaatggtttgtgggaggttagattttctgaacgaagatgaagatatgcaaattcttttcaaattaattttgggcaaatgatgaagctagactgataattgattaattttgggcaaataatattatattacatgtatgagattgattttaagtgtatatgcatacatgaagcaatagacttaatttaattatcttaaggagtgctggacttttgaggatgcccttttgtgctgatgagccctccatggttgacatacaaagcaaattgcagggtgtctttagctgaggtttttgctgcttcgaagtggcaattgaatcagctccgttggacagtgacatggtgatggtggtgataattaattcggcttaagggtaagtacaacttcttagctctgtaagcaaaggatgccttgtggagttggttcatctaatccacgtatatatagggctgaacgagggaacaagagttttcaatcaatgattacaattccacactctcgcctctaaagtgcatccctcacattgaagcatcctccaaatcccaaaatattattattaccacttaaagctattacaaatcagaaaacactgcag

SEQ ID NO: 165 - DNA, 607 bp, Artificial Sequence
  Consensus Reference Sequence
  misc_feature 9, 10, 11, 12: n = A,T,C or G
tcaaagtannnnaagttattagacatgaaattgtttawgataaataatctattgtaattaagcaagccatgttgggctaggaacactatcaactagtaggatttaagtctagtctctttaagcgaatttacaagtttatggatagcattcaatgtatttcttaaggtggtatcaccctcgwtgatmattttcacaaattgacacgtggtgcgttaggaattttgtttttaataattttccacaytaaaaagtgattttcatgtggctcaatttttttttaaaaaaaaaattgaattaacactmatgtgacatttttatgtggaacatgtcaacctatataagtaataatttagaagttaccacctgaactaatgcgtttcaaattcaaatgataatatatgatttatgtgactgytagttcattttatttaaaaaatattmamaaratcacwagamaytrkmaattgtcaattcackatttgataatgatatgacaaataattccatattagtaaattwtttcaaaataattcccttgtaatatttcaaaataggataaaytaccatatttgagtcattaattgtgtaagcgtggtcgcattaatcc

SEQ ID NO: 166 - DNA, 607 bp, Artificial Sequence
  Consensus Reference Sequence
  misc_feature 9, 10, 11, 12: n = A,T,C or G
tcaaagtannnnaagttattagacatgaaattgtttawgataaataatctattgtaattaagcaagccatgttgggctaggaacactatcaactagtaggatttaagtctagtctctttaagcgaatttacaagtttatggatagcattcaatgtatttcttaaggtggtatcaccctcgwtgatmattttcacaaattgacacgtggtgcgttaggaattttgtttttaataattttccacaytaaaaagtgattttcatgtggcttaatttttttttaaaaaaaaaattgaattaacactmatgtgacatttttatgtggaacatgtcaacctatataagtaataatttagaagttaccacctgaactaatgcgtttcaaattcaaatgataatatatgatttatgtgactgytagttcattttatttaaaaaatattmamaaratcacwagamaytrkmaattgtcaattcackatttgataatgatatgacaaataattccatattagtaaattwtttcaaaataattcccttgtaatatttcaaaataggataaaytaccatatttgagtcattaattgtgtaagcgtggtcgcattaatcc

SEQ ID NO: 167 - DNA, 566 bp, Artificial Sequence
  Consensus Reference Sequence
  misc_feature 5, 7, 9, 420, 467, 481, 482, 495, 503, 504, 523, 527, 544,549: n = A,T,C or G
yyctnananttgtttacatcttatacagaacttgagtttgaaaacgaaaattgtaagagcaacttttaatcatcttttcatccagtgcatgcttgaaaactttgtcagaagacaaattagtgkaagcatatatattaatttcaataatttattatggaattatcatatgataccatcccaaactcattccatgtttcccaaacagaatgaataatgatattasgcaccgttcaaattcaacatgattttgacaataraaatccagccagattaaatttttgttccactatatctcacacaagctttacaatcggacaaactggttactatacaactactatgttttttcttttcttttcttttaatctctgttcccattttatcacaagtatttcttttttgtcatttatwaaaaaaaangtaagraaaattaatactgtaaattataaayacatgccatataaaanttgtgtaaaaaaannaaataaacgcatngccatatnnaaaaacacatgtcataaancaancgttttaaattgtggtnctctnggtcagcagccacwtgg

SEQ ID NO: 168 - DNA, 566 bp, Artificial Sequence
  Consensus Reference Sequence
  misc_feature 5, 7, 9, 420, 467, 481, 482, 495, 503, 504, 523, 527, 544,549: n = A,T,C or G
yyctnananttgtttacatcttatacagaacttgagtttgaaaacgaaaattgtaagagcaacttttaatcatcttttcattcagtgcatgcttgaaaactttgtcagaagacaaattagtgkaagcatatatattaatttcaataatttattatggaattatcatatgataccatcccaaactcattccatgtttcccaaacagaatgaataatgatattasgcaccgttcaaattcaacatgattttgacaataraaatccagccagattaaatttttgttccactatatctcacacaagctttacaatcggacaaactggttactatacaactactatgttttttcttttcttttcttttaatctctgttcccattttatcacaagtatttcttttttgtcatttatwaaaaaaaangtaagraaaattaatactgtaaattataaayacatgccatataaaanttgtgtaaaaaaannaaataaacgcatngccatatnnaaaaacacatgtcataaancaancgttttaaattgtggtnctctnggtcagcagccacwtgg

SEQ ID NO: 169 - DNA, 538 bp, Artificial Sequence
  Consensus Reference Sequence
  misc_feature 477, 479, 480, 482, 487, 492, 497, 498, 499, 501, 502, 504,506, 507, 509, 512, 513, 517, 520, 521, 525, 526, 528, 529,530, 532, 533, 534, 535: n = A,T,C or G
tgttttgttacgcttcttttttgtacacagttatgccaattttgatttcttgttttaattatgtgttgtgtggcttggttttgtgtttcagtgactcgtgctattgttccgagaatgaacttggacgagctgtttgagcagaagggtgaggttgccaaagctgtcttggaggaacttgaaaaggtatcttacttcttttatttaagtaagttctggcattcttgaattaaatatgtaagaaaagtgaagagaagcttagtattagttgttgttcacaaaatatcaaattatttcatttccttttaaaattatactagcttgttgtttgcacatgtaaaagagttcatgttaaaagcatctgttttgaagtactggtgaagagagtagacagcctcgtgttgtgaaaagggttgggggaggggggggtggactaagaaggactttggaggaaattgttaaaagggacctcgtcttaantnntnttccngaaanttggnnntnncntnncncanngatntcnngtgnntnnngnnnntgg

SEQ ID NO: 170 - DNA, 538 bp, Artificial Sequence
  Consensus Reference Sequence
  misc_feature 477, 479, 480, 482, 487, 492, 497, 498, 499, 501, 502, 504,506, 507, 509, 512, 513, 517, 520, 521, 525, 526, 528, 529,530, 532, 533, 534, 535: n = A,T,C or G
tgttttgttacgcttcttttttgtacacagttatgccaattttgatttcttgttttaattatgtgttgtgtggcttggttttgtgtttcagtgactcgtgctattgttccgagaatgaacttggacgagctgtttgagcagaagggtgaggttgccaaagctgtcttggaggaacttgaaaaggtatcttacttcttttatttaagtaagttctggcattcttgaattaaatatgtaagaaaagtgaagagaagcttagtattagttgttgttcacaaaatatcaaattatttcatttccttttaaaattatactagcttgttggttgcacatgtaaaagagttcatgttaaaagcatctgttttgaagtactggtgaagagagtagacagcctcgtgttgtgaaaagggttgggggaggggggggtggactaagaaggactttggaggaaattgttaaaagggacctcgtcttaantnntnttccngaaanttggnnntnncntnncncanngatntcnngtgnntnnngnnnntgg

SEQ ID NO: 171 - DNA, 718 bp, Artificial Sequence
  Consensus Reference Sequence
gcggcagatgggcgtctagagatatgtggtatgatatatatataaatatataatatgtagccccgaaataacttcacttgatttttatcccattcacgagagtagctagattgaaacaacattgtccgttggcctaagttcaaatagtcaaccagaataaaatgcaggctgatcatatctatttttgattttgactatttaccaaaaccaatcaaatggaagttgtctagctagtctattctggcgccaaatggcttacttctcaccttctgttgtattggagtaagtatgaggtgcagttccaaatctcatagaagtgagaaaaaaaacatataaaatgagtaaaagattcataaacctaatctttgaagttttgaattaaaatgtagtgttaaatttccttgtgtgattcattggtataaatctttagttcagtgaaatgggaccagggttatgatgttactgctcattttcttgactattagcagatgagggatggttacagtgatcaactctttgttcagttactgggaaaagcagtttatcagctttggcaagactacaaggctaagtatggcaccagttaagaggctatgagagctttgcatgttattttttaaaaatataagcgagtatatatgtcgcaatctatttgtatataggttaatttgtattaattctatgtttattcagcggaatggcatggtcatagcctgtt

SEQ ID NO: 172 - DNA, 718 bp, Artificial Sequence
  Consensus Reference Sequence
gcggcagatgggcgtctagagatatgtggtatgatatatatataaatatataatatgtagccccgaaataacttcacttgatttttatcccattcacgagagtagctagattgaaacaacattgtccgttggcctaagttcaaatagtcaaccagaataaaatgcaggctgatcatatctatttttgattttgactatttaccaaaaccaatcaaatggaagttgtctagctagtctattctggcgccaaatggcttacttctcaccttctgttgtattggagtaagtatgaggtgcaattccaaatctcatagaagtgagaaaaaaaacatataaaatgagtaaaagattcataaacctaatctttgaagttttgaattaaaatgtagtgttaaatttccttgtgtgattcattggtataaatctttagttcagtgaaatgggaccagggttatgatgttactgctcattttcttgactattagcagatgagggatggttacagtgatcaactctttgttcagttactgggaaaagcagtttatcagctttggcaagactacaaggctaagtatggcaccagttaagaggctatgagagctttgcatgttattttttaaaaatataagcgagtatatatgtcgcaatctatttgtatataggttaatttgtattaattctatgtttattcagcggaatggcatggtcatagcctgtt

SEQ ID NO: 173 - DNA, 625 bp, Artificial Sequence
  Consensus Reference Sequence
gtacactttgcttaaccaactcaactcaactttttagtgcctttaaaagtagaaaaaggaagtcgtgtttgagagaaaaagataaacttgaaactgaagaaaaagctaagagcttaacctctctcctaaaagctaactaaaactaacagaatgtgcaccctcgcatgtggcaaccccactaagctcctacatgtcagttccctcctaaccaactccctgctcatcagggttgattttcttctctttcaaaggctttcagcctttgttctgactaaactaagcccaatttctatctgctagcctggtctaacagaaggggatatgatwtaacatcgtattctcaaaattggcacggatagatcctattatttaatcttaaacttgttaaaggatataatcttatattctcaaaatcggcatgaggtggtcctattatttacacttgaactttgtgaaggacattttgatttgtatctttgaactttataatatgattagtacagcagtatggaatttgtgaagatattttctgagggcagactgttcaagggcatggttttaatttttttatgtatgaaccccatagtttctgtccacatcatcatgcccatggtcatagcykktt

SEQ ID NO: 174 - DNA, 625 bp, Artificial Sequence
  Consensus Reference Sequence
gtacactttgcttaaccaactcaactcaactttttagtgcctttaaaagtagaaaaaggaagtcgtgtttgagagaaaaagataaacttgaaactgaagaaaaagctaagagcttaacctctctcctaaaagctaactaaaactaacagaatgtgcaccctcgcatgtggcaaccccactaagctcctacatgtcagttccctcctaaccaactccctgctcatcagggttgattttcttctctttcaaaggctttcagcctttgttctgactaaactaagcccaatttctatctgctagcctggtctaacagaaggggatatgatwtaacatcgtattctcaaaattggcacggatagatcctattatttaatcttaaacttgttaaaggatataatcttatattctcaaaatcggcatgaggtggtcctattatttacacttgaactttgtgaaggacattttgatttgtatctttgaactttataatatgactagtacagcagtatggaatttgtgaagatattttctgagggcagactgttcaagggcatggttttaatttttttatgtatgaaccccatagtttctgtccacatcatcatgcccatggtcatagcykktt

SEQ ID NO: 175 - DNA, 625 bp, Artificial Sequence
  Consensus Reference Sequence
tatcgtacctgataawtgtcaaaaacctttccaactccatggtatagacatcaacagcttgttccaagacggtgatttgttccatttttctatcaaattatacccagagagagaagataaagtgttacaaaaatcctccatgttctaaaagactaccaaaacaccacatcttccatggaaggaaattaaaaagcctctcaatctctctaaaaaatagaacaagtcccataaacagcttgtgagctgacaccaaatggaagcaagatgtccaattctgtatcatgataaaatgatgggcaaaacttatataaggttccataggtgctgtttgtgcaattctcccatcaaaattggagttttaacttggcaatttgcaagatagaaatttgcattaaaggattatgcaaattaccttggtgaaactccaattttgattggagaacgtgtaaacaacacttgaggaactgtaaacaagttatttcctaaaataaccttctagctcaaatgagttctaaaacatcacttaaccgaagcgccaaataaaagaaaacaaggaacatctcaacaagacgacccttgttctcagttccatgatatgcacacgattccatggtcatagcykkkt

SEQ ID NO: 176 - DNA, 625 bp, Artificial Sequence
  Consensus Reference Sequence
tatcgtacctgataawtgtcaaaaacctttccaactccatggtatagacatcaacagcttgttccaagacggtgatttgttccatttttctatcaaattatacccagagagagaagataaagtgttacaaaaatcctccatgttctaaaagactaccaaaacaccacatcttccatggaaggaaattaaaaagcctctcaatctctctaaaaaatagaacaagtcccataaacagcttgtgagctgacaccaaatggaagcaagatgtccaattctgtatcatgataaaatgatgggcaaaacttatataaggttccataggtgctgtttgtgcaattctcccatcaaaattggagttttaacttggcaatttgcaagataaaaatttgcattaaaggattatgcaaattaccttggtgaaactccaattttgattggagaacgtgtaaacaacacttgaggaactgtaaacaagttatttcctaaaataaccttctagctcaaatgagttctaaaacatcacttaaccgaagcgccaaataaaagaaaacaaggaacatctcaacaagacgacccttgttctcagttccatgatatgcacacgattccatggtcatagcykkkt

SEQ ID NO: 177 - DNA, 657 bp, Artificial Sequence
  Consensus Reference Sequence
tccyygacataytyccaataaactygtattcatatgmryctctgtttcaaacaaacaaaaaagttctgatgaagtcagcctaaaatccttgcatccatgtcttgataggtacattaattgtcaaggttaacaagagcatttcttttctatttaaatttkactagttaaatcaatmgacaagtaaaacctaatccaataaaaaccataaagtaaawtatattagtatgattgtatacccatctttgaaatgagagccagacaagtcagctacttgtttcaaagccatcctccattcctgcagcttctccatcttatctttgaacctttcctgatgcttagtcattgcttctccataactacctttctggtgtctgacataagaaggatcgactttgtaaaagaccggtataaccaacagcccttccctcttgcagtgaaagatggttacaagttcatctaaacaaaatgaggaaaaagcatagttttcagaaagcacaataatagcaaccctggaatcttgaattgccttcaaaagtgcaggtgttatttcctctccgctgtgaagcttgtcttcgtcaaagaaggtatgaaatcccttgtcacaaagagccttgtagagatwgccagtaaaaccatagcgtgtgtctgtccctctga

SEQ ID NO: 178 - DNA, 657 bp, Artificial Sequence
  Consensus Reference Sequence
tccyygacataytyccaataaactygtattcatatgmryctctgtttcaaacaaacaaaaaagttctgatgaagtcagcctaaaatccttgcatccatgtcttgataggtacattaattgtcaaggttaacaagagcatttcttttctatttaaatttkactagttaaatcaatmgacaagtaaaacctaatccaataaaaaccataaagtaaawtatattagtatgattgtatacccatctttgaaatgagagccagacaagtcagctacttgtttcaaagccatcctccattcctgcagcttctccatcttatctttgaacctttcctgatgcttagtcattgcttctccataactacctttctggtgtctgacataagaaggatctactttgtaaaagaccggtataaccaacagcccttccctcttgcagtgaaagatggttacaagttcatctaaacaaaatgaggaaaaagcatagttttcagaaagcacaataatagcaaccctggaatcttgaattgccttcaaaagtgcaggtgttatttcctctccgctgtgaagcttgtcttcgtcaaagaaggtatgaaatcccttgtcacaaagagccttgtagagatwgccagtaaaaccatagcgtgtgtctgtccctctga

SEQ ID NO: 179 - DNA, 643 bp, Artificial Sequence
  Consensus Reference Sequence
tkggacctatcacttccaaagctaatggaaggccagaagcataaatwactacatcattcaagacctccttataacttggatcaaccttttcggttttaaaagatttccatgtaagcaattgaagagcattgttctcattcaatagttccacttcatatgttcttttaaccccatgagatgctagcagttgtttgtcccgagtggtgatgatgactctactgcctggaccaaaccaacaaggtcttccaacaatagcctgtaattgttcatgcttgtcaacatcatctaaaatcaagagaaccttctttcgctgaagccgatgttgtataattgaagctccttgttcaacacttgctaagttgatttccttctctccaaktatttcccgaagaaggatgctctggaggtgttgtaaccccttcttgtttgatttttctctcaaatctttaagaaaacatgaaccatcaaaatgrcaagcaatcaaattataaactgctatagcaagtgttgattttcctatcccaccaattccatggatccctatcatgtagacaccawcatcagattcaacatccaaaagctttgttacttctagkaatcttgattctagtccaaccgggtaatcccatggtcawagcykktt

SEQ ID NO: 180 - DNA, 643 bp, Artificial Sequence
  Consensus Reference Sequence
tkggacctatcacttccaaagctaatggaaggccagaagcataaatwactacatcattcaagacctccttataacttggatcaaccttttcggttttaaaagatttccatgtaagcaattgaagagcattgttctcattcaatagttccacttcatatgttcttttaaccccatgagatgctagcagttgtttgtcccgagtggtgatgatgactctactgcctggaccaaaccaacaaggtcttccaacaatagcctgtaattgttcatgcttgtcaacatcatctaaaatcaagagaaccttctttcgctgaagcctatgttgtataattgaagctccttgttcaacacttgctaagttgatttccttctctccaaktatttcccgaagaaggatgctctggaggtgttgtaaccccttcttgtttgatttttctctcaaatctttaagaaaacatgaaccatcaaaatgrcaagcaatcaaattataaactgctatagcaagtgttgattttcctatcccaccaattccatggatccctatcatgtagacaccawcatcagattcaacatccaaaagctttgttacttctagkaatcttgattctagtccaaccgggtaatcccatggtcawagcykktt

SEQ ID NO: 181 - DNA, 584 bp, Artificial Sequence
  Consensus Reference Sequence
tttttggttcaggtctgcaacaaaaaagcctctgggtcagagcactcatgctaacaccatacttgggacaccaactgggcgtcgaatgctttcgacgccttctggccgccatggaaactcaggaggaaaggaccgtagagaaagtggcagagtgaacagcataattccagtgaactatgttgctcttccaaaagatgactmtgtttctagggggaattaagggctgccctctaatttgactcctgaatcagtcagctttgaaaatgcgcttattstacaagctctattatgtttccttctgaaacgttatgcattgtaaatttggtaaatgacaaatgaatgacccattctaggcttgatatagaagattgtacaagtcacgggctaaatagattacaaatataaaaagaagtcattcttgttctttcatgtgtgtaagttgtctgatttgattcttcaaaaatgaggtgtactttagagaataaagggtacttataattaatttatcagaaaattaatagttgagaagtttgataaaattagatacatatatgrcaatttagakwtrayrwtytarwktwwaw

SEQ ID NO: 182 - DNA, 584 bp, Artificial Sequence
  Consensus Reference Sequence
tttttggttcaggtctgcaacaaaaaagcctctgggtcagagcactcatgctaacaccatacttgggacaccaactgggcgtcgaatgctttcgacgccttctggccgccatggaaactcaggaggaaaggaccgtagagaaagtggcagagtgaacagcataattccagtgaactatgttgctcttccaaaagatgactmtgtttctagggggaattaagggctgccctctaatttgactcgtgaatcagtcagctttgaaaatgcgcttattstacaagctctattatgtttccttctgaaacgttatgcattgtaaatttggtaaatgacaaatgaatgacccattctaggcttgatatagaagattgtacaagtcacgggctaaatagattacaaatataaaaagaagtcattcttgttctttcatgtgtgtaagttgtctgatttgattcttcaaaaatgaggtgtactttagagaataaagggtacttataattaatttatcagaaaattaatagttgagaagtttgataaaattagatacatatatgrcaatttagakwtrayrwtytarwktwwaw

SEQ ID NO: 183 - DNA, 792 bp, Artificial Sequence
  Consensus Reference Sequence
ttaagtgactttaaaatatgacacattgaaatgacctgtttggatattaaatttaaagaattttcaaaaatgatgagaaatttattggaatttttttttaaaataaaatagaattacaaaacgctgacaaggtgttttggtagggagagattcttttcaatttcttagaaatcttggaagtgttaaattcctatatttgatataactattttaatgatcattttcataaatctaaaattcacaagaatcatttttgaataagtcttctactaaacgtggttcggtggagagactctacaaaatgaggtcagacatcgtaggatgttagtcaagcatcggccaaaccagtaaatacttcatatcatatcaatcatatgatgataaaaaaacgctttcttaagacaccgtgaactctagaaaacacataaaatgaaatctgcacaagcttaaagcacatgactaaataactttatcaaaataaaaaactaaaatacaggaaagttgaattgctttatccaaataaaatttaaaaaacgaaagaagtttaatttgcaaatagcttgaatttttcaaataccatactcaaaaattaccttgatttttctgggtccggtaacgttccacgttgggcttaaactaactttgccatggaaactctgattggagtaacggaggatgcacacatcataccataggatagcggtaacactgtcaggacacagccgagagatttcattgacagcagtggtgagacagaactggcagaagtatcctgtgatgtcgtatctgcag

SEQ ID NO: 184 - DNA, 792 bp, Artificial Sequence
  Consensus Reference Sequence
ttaagtgactttaaaatatgacacattgaaatgacctgtttggatattaaatttaaagaattttcaaaaatgatgagaaatttattggaatttttttttaaaataaaatagaattacaaaacgctgacaaggtgttttggtagggagagattcttttcaatttcttagaaatcttggaagtgttaaattcctatatttgatataactattttaatgatcattttcataaatctaaaattcacaagaatcatttttgaataagtcttctactaaacgtggttcggtggagagactctacaaaatgaggtcagacatcgtaggatgttagtcaagcatcggccaaaccagtaaatacttcatatcatatcaatcatatgatgataaaaaaacgctttcttaagacaccgtgaactctagaaaacacataaaatgaaatctgcacaagcttaaagcacatgactaaataactttatcaaaataaaaaactaaaatacaggaaagttgaattgctttatccaaataaaatttaaaaaacgaaagaagtttaatttgcaaatagcttgaatttttcaaataccataccaaaaaattaccttgatttttctgggtccggtaatgttccacgttgggcttaaactaactttgccatggaaactctgattggagtaacggaggatgcacacatcataccataggatagcggtaacactgtcaggacacagccgagagatttcattgacagcagtggtgagacagaactggcagaagtatcctgtgatgtcgtatctgcag

SEQ ID NO: 185 - DNA, 330 bp, Artificial Sequence
  Consensus Reference Sequence
gaattgtaatacgactcactatagggcgaattgggccctctagatgcatgctcgagcggccgccagtgtgatggatatctgcagaattcgcccttcaggaaagttgaattgctttatccaaataaaatttaaaaaacgaaagaagtttaatttgcaaatagcttgaatttttcaaataccatactcaaaaattaccttgatttttctgggtccggtaatgttccacgttgggcttaaactaactttgccatggaaactctgaagggcgaattccagcacactggcggccgttactagtggatccgagctcggtaccaagcttggcgtaat

SEQ ID NO: 186 - DNA, 330 bp, Artificial Sequence
  Consensus Reference Sequence
gaattgtaatacgactcactatagggcgaattgggccctctagatgcatgctcgagcggccgccagtgtgatggatatctgcagaattcgcccttcaggaaagttgaattgctttatccaaataaaatttaaaaaacgaaagaagtttaatttgcaaatagcttgaatttttcaaataccatactcaaaaattaccttgatttttctgggtccggtaacgttccacgttgggcttaaactaactttgccatggaaactctgaagggcgaattccagcacactggcggccgttactagtggatccgagctcggtaccaagcttggcgtaat

SEQ ID NO: 187 - DNA, 595 bp, Artificial Sequence
  Consensus Reference Sequence
ktkrattggctactaaaacaaatgctatatttgtaaatatataccaatatagcaatacaggggtaattgaaaattctgattaactgttratctacaggttaacagtcttcggcaggaactacaacttcttgctagagatagatcaatcactattgtaaatgcaagtggaacaggtactggttagctactttcttatacacattataggggccttttgttatttcttcagcaatttaataaatgttgatgtgttaatttgcaaacccatgataactggttttaattgtgggctgtctccatactctrcacaagctaamcaatgtttccttattattttttactcctkttttattttctgacttgtttgggaaatgcacaggtgggagaaaatatgcaacagtgattgttattgttgtggtaggatatggatacgtttggtggaaggtaatgycttttctctctcaattkttgatttaagtaacaggatgctgtagtgatacattcttrttggaagctttatggctaatttgaatttraatattggtgcttwtaacgagtgccatctgctctttgcacayggatactctccacttaa

SEQ ID NO: 188 - DNA, 595 bp, Artificial Sequence
  Consensus Reference Sequence
ktkrattggctactaaaacaaatgctatatttgtaaatatataccaatatagcaatacaggggtaattgaaaattctgattaactgttratctacaggttaacagtcttcggcaggaactacaacttcttgctagagatagatcaatcactattgtaaatgcaagtggaacaggtactggttagctactttcttatacacattataggggccttttgttatttcttcagcaatttaataaatgttgacgtgttaatttgcaaacccatgataactggttttaattgtgggctgtctccatactctrcacaagctaamcaatgtttccttattattttttactcctkttttattttctgacttgtttgggaaatgcacaggtgggagaaaatatgcaacagtgattgttattgttgtggtaggatatggatacgtttggtggaaggtaatgycttttctctctcaattkttgatttaagtaacaggatgctgtagtgatacattcttrttggaagctttatggctaatttgaatttraatattggtgcttwtaacgagtgccatctgctctttgcacayggatactctccacttaa

SEQ ID NO: 189 - DNA, 650 bp, Artificial Sequence
  Consensus Reference Sequence
  misc_feature 255, 257, 422, 498, 628: n = A,T,C or G
ttgatggaaattcatttgaagggaatattccgtccgagattggaaattgtagctctctttacttgctgtatgcatcctatttctcaagctctagtgtcatttctyttaacacatctttttggaagatatactaattcctatctattttatgcaggagtttgtctcacaataatttgactggttcaattccaaagtccatgtcaaagctaaacaagctcaaaatcctcaagctggaattcaatgaactaagtggananataccaatggagcttggaatgcttcagagtcttcttgctgtaaacatatcatacaacaggctcacaggaaggcttcctacaagtagcatatttcagaacttggacaaaagttccttggaaggaaacctgggtctttgttcacccttgttgaagggtccatgtaanatgaatgtccccaaaccactwgtgcttgacccaaatgcctataacaaccaaataagtcctcaaaggcaaacaaacnaatcatctgagtctggcccagtccatcgccacaggttccttagtgtatctgctattgtagcaatatctgcatcctttgtcattgtattaggagtgattgctgttagcctacttaatgtttctgtaagganaagctaacatttttggataatg

SEQ ID NO: 190 - DNA, 650 bp, Artificial Sequence
  Consensus Reference Sequence
  misc_feature 255, 257, 422, 498, 628: n = A,T,C or G
ttgatggaaattcatttgaagggaatattccgtccgagattggaaattgtagctctctttacttgctgtatgcatcctatttctcaagctctagtgtcatttctyttaacacatctttttggattatatactaattcctatctattttatgcaggagtttgtctcacaataatttgactggttcaattccaaagtccatgtcaaagctaaacaagctcaaaatcctcaagctggaattcaatgaactaagtggananataccaatggagcttggaatgcttcagagtcttcttgctgtaaacatatcatacaacaggctcacaggaaggcttcctacaagtagcatatttcagaacttggacaaaagttccttggaaggaaacctgggtctttgttcacccttgttgaagggtccatgtaanatgaatgtccccaaaccactwgtgcttgacccaaatgcctataacaaccaaataagtcctcaaaggcaaacaaacnaatcatctgagtctggcccagtccatcgccacaggttccttagtgtatctgctattgtagcaatatctgcatcctttgtcattgtattaggagtgattgctgttagcctacttaatgtttctgtaagganaagctaacatttttggataatg

SEQ ID NO: 191 - DNA, 401 bp, Artificial Sequence
  Consensus Reference Sequence
acataatcttacatgagtcaaccctattaatragtcaaccctattcattagatttttactcttactatatcaattttattagcaaaatctttagtatttttaaccasctaaaggtattttatttttaataaatgwattgaatgcataatattgaatgtaaatcttgacaaatatatgataataaaaaaggaatttgaaatattgaaattcaaagggggaattattgtaatgcataatttaaatattcaattaaaatttwaaagtgagacttcatttkyttttagactgaatcaaataattagctagttttgaatataactttggatatatctttaatttttcactttacacatgtttttttacattaaagttaaatttkaaaaygaatttatcstttaaaa

SEQ ID NO: 192 - DNA, 401 bp, Artificial Sequence
  Consensus Reference Sequence
agaccaagcttggaaatcaatgaattgaaggagggagcaggcartggcttggtaagtacatctgscaattgtgcaacagaagaaaytggcaggagatgaatgaggccartttgtattttctcacgaatgacatgacagtcaatttcaatatgttttgtcctctcatggaagatggggytgtgagcaagatagatagcactcttattatcacwgtaggctgagataggttgatcaagagagatgtgaagatccttgaacaaataytgcagccattstaattcacaagttaagctagccaaagctctatattctgcttctgaacttgacctrgatattgtggactgctttttggatttccaagacagcatagatgtgccaagaaagacacagtaaccagtcac

SEQ ID NO: 193 - DNA, 401 bp, Artificial Sequence
  Consensus Reference Sequence
ttctataagagaactaatggacagacaaaaaygtttgtgacatggactacatttgtcatatgatagtatagaagaaagagggtaaggagatttacctggattagatgctskcagcattgaggatagcaaattgcagtggtattcagagagataagmaggaggttttgttagtctatgtgattttctggttggtgcaggagaggaggtaggttcatttggtggaggtaaggatagtggaagatctaggagaatgtcagatgtgtctaagttagtaatatcagggttgacactracagrattattggcaggkggaggtgaggcaaaaggaaagacagtttcatggaagattacattccttgaaacatagaactcatgggtgataggatcataaagaaggtagc

SEQ ID NO: 194 - DNA, 401 bp, Artificial Sequence
  Consensus Reference Sequence
agtaataaaattgaaaacagttcctgatattgcaattcatccctcactttagttcaaattcaaaaaatcgtgtgatttargtggacttcaaaaaaataaaataaataataagtggwtaagtttagaaatttatttttcttcaaaaaaaataattttgraaacttatttgacaatataagaatttatttttaaatttcttagcttaaagggattaatgcgaccacgcttacacaattaatgactcaaatatggtartttatcctattttgaaatattacaagggaattattttgaaawaatttactaatatggaattatttgtcatatcattatcaaatmgtkaattgacaatttctagtgtcttgtgattyttttaaataaaatgaactarcagtcacata

SEQ ID NO: 195 - DNA, 401 bp, Artificial Sequence
  Consensus Reference Sequence
  misc_feature 368: n = A,T,C or G
caaattcaaaaaatcgtgtgatttargtggacttcaaaaaaataaaataaataataagtggwtaagtttagaaatttatttttcttcaaaaaaaataattttgraaacttatttgacaatataagaatttatttttaaatttcttakcttaaagggattaatgcgaccacgcttacacaattaatgactcaaatatggtaatttatcctattttgaaatattacaagggaattattttgaaawaatttactaatatggaattatttgtcatatcattatcaaatmgtkaattgacaatttctagtgtcttgtgattyttttaaataaaatgaactarcagtcacataaatcatatattatcatttgantttgaaacgcattagttcaggtggtaacttcta

SEQ ID NO: 196 - DNA, 401 bp, Artificial Sequence
  Consensus Reference Sequence
agattatttatcwtaaacaatttcatgtctaataacttgttttacttttgaagtgaaactagtaacttggtgtacaatatcctcacaagtactgcataatcagtaawttttgccagttgaattggagagytctattcaaagtagccaagtatcattgagggtggtgtcaccttaattagccagcaattttcacaaacaaaatacacaatatgatgcactaggtkttttttttttacaaaaaaaattgccacatcatatgatgatattcaagtagttttaatttattttttcaaaggagttgacactcasgtgtcmtgctacatgagatacactagtcyaatcataacaatataaaagttgctaattgaatttacacattctaagtaggttcttamttcaaa

SEQ ID NO: 197 - DNA, 401 bp, Artificial Sequence
  Consensus Reference Sequence
  misc_feature 309: n = A,T,C or G
catcatatgatgatattcaagtagttttaatttattttttcaaaggagttgacactcasgtgtcmtgctacatgagatacactagtcyaatcataacaatataaaagttgctaattgaatttacacattctaagtaggttcttamttcaaaaaaaaaaatggtcaatctatatggctattttgataataatgtaacaatagcaactctaaatttttttgtacatactttatgatttaatctctgttatgttaatcaatcaaaaagattaagttagcggacaaaagctttttagtttgagaatttgaganatttagttgcataagtcttttttgttctaagaaaaagaatacttcttacctcattattcttttttcaacaacccaccttttgaatataagta

SEQ ID NO: 198 - DNA, 401 bp, Artificial Sequence
  Consensus Reference Sequence
  misc_feature 51: n = A,T,C or G
tataaattattcaaaataaatattgtaccaaaataccaaaatataataaanaatgtaataattattataaatttatcyaaattataataattagtcacaatctattataaataaaagataaatttatctcatatttcacttyttygaatcttggtgytaggcagtcttggtatgrgtatgaagctcatgtaatttgattgattcttgttatgagatacttcatctgggattataattcaaattggtgctaaagrcctaactrgaggtggtctgaacacaattgacattggtggaggtacgaagattgtttcatayagcaataataaatarcrattagttatrcataacatwatttaacattaattaatcaattaaatgtaaaaatcactcatatgacttgg

SEQ ID NO: 199 - DNA, 401 bp, Artificial Sequence
  Consensus Reference Sequence
tgtaataattattataaatttatcyaaattataataattagtcacaatctattataaataaaagataaatttatctcatatttcacttyttygaatcttggtgytaggcagtcttggtatgrgtatgaagctcatgtaatttgattgrttcttgttatgagatacttcatctgggattataattcaaattggtgctaaagacctaactrgaggtggtctgaacacaattgacattggtggaggtacgaagattgtttcatayagcaataataaatarcrattagttatrcataacatwatttaacattaattaatcaattaaatgtaaaaatcactcatatgacttggagttggaacactttgagctsgagcactttcagcattargagtttgagtaattt

SEQ ID NO: 200 - DNA, 401 bp, Artificial Sequence
  Consensus Reference Sequence
tgcaagcaaactcacacaaccaaaaygcaacraygacgacaccattacgccgacgatagcaacagtgctgttaygaccaaccaaaatkrcatacrcgtacaagaaaaaattgaagaaaagcgcgaacaagaacaaaygaaaaaatggaagagccagcgtgaagaatgcaaacttgggtaagcatgaagaagaacaacaacaaatrtttggraaatgaagcaatggaagggcgcaagaagaagaacaagagccaacgttaaaaaaaggaagcaccttggggaagccagaagaagaaaaaaaatgtttgggaaagaaagcmaraagaaaaagaggtataaacaagygtgaacaatgaatttttatttgaaattgttaatgccacaaatattcctattycaaag

SEQ ID NO: 201 - DNA, 401 bp, Artificial Sequence
  Consensus Reference Sequence
atggaagagccagcgtgaagaatgcaaacttgggtaagcatgaagaagaacaacaacmaatrtttggraaatgaagcaatggaagggcgcaagaagaagaacaagagccaacgttaaaaaaaggaagcaccttggggaagccagaagaagaaaaaaaatgtttgggaaagaaagcmaraagaaaaagaggtataaacaagcgtgaacaatgaatttttatttgaaattgttaatgccacaaatattcctattycaaagtgtgggaatataagtcaataaaatgttacwtgataaatatgtycctttgtgtcatgttgatatttttgtcastgacaaatttgtctctttgtgttaacgrtcggatatatttatyacactttttacacttttgaarattaaat

SEQ ID NO: 202 - DNA, 401 bp, Artificial Sequence
  Consensus Reference Sequence
aagtgtgggaatataagtcaataaaatgttacwtgataaatatgtycctttgtgtcatgttgatatttttgtcastgacaaatttgtctctttgtgttaacgrtcggatatatttatyacactttttacacttttgaarattaaattttatatttacatcttttaagratatatttgttaaraaattacacattcaaaaacaaaagtagttatttactctaatttgcgtgagcagagatcaagatattggtacctacattttcaaattccaatccagaaaaaagcacagccaatgataaattaagttmaaaagggttgaaaatatgcacacataaagacargagtaaatctcaaaaatcttcaaatataaacaaatgattaaaatcacaaaactcttgata

SEQ ID NO: 203 - DNA, 401 bp, Artificial Sequence
  Consensus Reference Sequence
agtttccttggggatattgtaatagaagaacaagaagtcatgggaaaactttytttttgaaagagattgatctaataagctccaagtccaatagggtatttgatgttgaacaacaagcagcwagtgatgatggagtttgtgttagtgttgaagaaggtttttagaagaaggctttatatataataaaggggaattgggttggaagagggggaataaagagagagagagagagagagagagagagagagagagagagagagagagagagagagagagagagagagagagagagagagagagagagagagagagagagagagagagagagagagagaragagagagagagagagagagagagagagagagagagagagrgrggggggggggatatggtttttt

SEQ ID NO: 204 - DNA, 401 bp, Artificial Sequence
  Consensus Reference Sequence
  misc_feature 114: n = A,T,C or G
gagagagagagagagagagagagagagagagrgrggggggggggatatggttttttattttatttttatgatattgttattttgtattattttattgctgtgagaaaaaaaarnaaaaatataaacatgggttttgggccatatggaatcacgaatagtgggtggaaacttgatgataaaaaaaaattgaaaaatgaaaactaaaaagatatgagtgcctcctctttacgatggcaaagtacaaacacaccagctaagctttctctstcttcattgcacaaaaaacaagacaatgtcttacaccatgttcttcacaagttttgggtgcatgaatgacccttaaattgtagccattgattttgtttttttaaataatcaattgcaagaagcaataacctgga

SEQ ID NO: 205 - DNA, 401 bp, Artificial Sequence
  Consensus Reference Sequence
aaattttatgcaaatttgaacaacagacatttgtttttgatattttggaaaatctaaagtaaytatcactcaaaagttaaagattgatattttaaaatattaagatttaatyaaaagattaattttttagtgaacatatacctaagaaataargttatatctgtcaatttatcaagtcacattgatatatgtgtatctatagatgaaacattaaaagaagaatagaatagtaagcaaacgtggagytggctcatgacccagtcmttattttgcttttacaaaagaaaaatgtttgttttactttactattttktatacaatattttatataaaagaaggaaaagactggaaaataaagtaaaaaaacaaggtaaataaacaatgtagatgaaggcgataaa

SEQ ID NO: 206 - DNA, 401 bp, Artificial Sequence
  Consensus Reference Sequence
tggaaaatctaaagtaaytatcactcaaaagttaaagattgatattttaaaatattaagatttaatyaaaagattaattttttagtgaacatatacctaagaaataargttatatctgtcaatttatcaagtcacattgatatatgtgtatctatrgatgaaacattaaaagaagaatagaatagtaagcaaacgtggagctggctcatgacccagtcmttattttgcttttacaaaagaaaaatgtttgttttactttactattttktatacaatattttatataaaagaaggaaaagactggaaaataaagtaaaaaaacaaggtaaataaacaatgtagatgaaggcgataaaaaataatattatataaataatrttcttttttacaaatttaagtaa

SEQ ID NO: 207 - DNA, 401 bp, Artificial Sequence
  Consensus Reference Sequence
ccttcttcttgtcgaactttaatgtagcaaatgtaacatcgcagaatcctccaataacaatgttatatagctggcagattattgagtgggtgtttgggacctacaaaattaaagcacacctaaatgtaactataatcwaacaaawtgattaatattttaacaaatacatgctagtttacattcaatacatactaattcacatgaagacaggaggaaagtgtywttttcgtttttaaattgagtattgatcattgtcctttgccttgaagatttgtgctgtttgcgactccctgtagcawttcatgcgtagaactcatagttataggagaaaatttaggtagtccaaaatcattacgtakttacgattttatctaatttttgagtcacacatactcaaaatt

SEQ ID NO: 208 - DNA, 401 bp, Artificial Sequence
  Consensus Reference Sequence
  misc_feature 232: n = A,T,C or G
taagcttaccacrtgcattatcctcgtaatcttcttcgttcttgtttcttgcatccttctcggggggagggagaattctagtacatagagcctytgcttcattactaawagattatttttaccagcgaaggaaaaattrgtatttaagatttacagaaatatgagatgtatgtactttaatctttacatcaacttctcctattgtttaatttaagatctaatctcttttcanaaaaaaaaaattaagatccaatctagactgttttatatttrtacatgaatctagattgttgttgaaaaatagattattgtttaatttagtagttgaaaratattwaatgtaaaagattgahccgttttaagaattggagcggcatgccacgaataaacttccaacttyt

SEQ ID NO: 209 - DNA, 401 bp, Artificial Sequence
  Consensus Reference Sequence
  misc_feature 160: n = A,T,C or G
gaattctagtacatagagcctytgcttcattactaawagattatttttaccagcgaaggaaaaattrgtatttaagatttacagaaatatgagatgtatgtactttaatctttacatcaacttctcctrttgtttaatttaagatctaatctcttttcanaaaaaaaaaattaagatccaatctagactgttttatatttatacatgaatctagattgttgttgaaaaatagattattgtttaatttagtagttgaaaratattwaatgtaaaagattgahccgttttaagaattggagcggcatgccacgaataaacttccaacttyttaccttgtgatrarattgacccattacaccatgtcaccatttaatacaattattttgccatgtgagatcgta

SEQ ID NO: 210 - DNA, 401 bp, Artificial Sequence
  Consensus Reference Sequence
kttttrtaaaagttattccaaacacttctttagaaaacacaactcaataatcatttattttttttkaagttaaaccatgttgcatatattaatcaaggctgagaaagccaataatacatcatggtttaccmtggattggatgtgagatggaatatcctcaatccaaaccgaatcaaaagatgaaaaagcaagtgtagcaaaactatgagctacgttgtttcctactcttttygtatgctctattctaggtagytrtgagtttcccaaaaagtgtttcattcaaaacctttacactccaaaagaaggtctttcgctatttgaaggctcaatctaagggmcattgcttctgcaatctgatgaggttagaagcatgaaggatcaaaagaggttgcagcagccat

SEQ ID NO: 211 - DNA, 401 bp, Artificial Sequence
  Consensus Reference Sequence
atttattttttttkaagttaaaccatgttgcatatattaatcaaggctgagaaagccaataatacatcatggtttaccmtggattggatgtgagatggaatatcctcaatccaaaccgaatcaaaagatgaaaaagcaagtgtagcaaractatgagctacgttgtttcctactcttttygtatgctctattctaggtagctrtgagtttcccaaaaagtgtttcattcaaaacctttacactccaaaagaaggtctttcgctatttgaaggctcaatctaagggmcattgcttctgcaatctgatgaggttagaagcatgaaggatcaaaagaggttgcagcagccattatctctccttgacaatttctaaatataacacccatatctgtgcctcttccg

SEQ ID NO: 212 - DNA, 401 bp, Artificial Sequence
  Consensus Reference Sequence
  misc_feature 24: n = A,T,C or G
taatatttgttttgtagaaaaaanyaatgtttttaaaaattaatagctagggttcatgactataattttgattgcaacattaagattttattktagtgtcctggattgtaattgaagttgcatcattcactttaatttgtcrgcaatatcaaaaaacaagaaattgctaccataattacaatttaaaactttggcaataacaattrggcgtggtagtatatgaagagaaaatcaaagtctggatggagaactttgaaaaggacatgccactataaaagagctttttatttaaaaataataattttwtaktttttagtttttttttaactaaaaaaactcaaattttttcacatttttttcttttacatttcatttamacgtacttttctttttatatctcc

SEQ ID NO: 213 - DNA, 401 bp, Artificial Sequence
  Consensus Reference Sequence
  misc_feature 19: n = A,T,C or G
tttgttttgtagaaaaaanyaatgtttttaaaaattaatagctagggttcatgactataattttgattgcaacattaagattttattktagtgtcctggattgtaattgaagttgcatcattcactttaatttgtcrgcaatatcaaaaaacaagaaattgctaccataattacaatttaaaactttggcaataasaattaggcgtggtagtatatgaagagaaaatcaaagtctggatggagaactttgaaaaggacatgccactataaaagagctttttatttaaaaataataattttwtaktttttagtttttttttaactaaaaaaactcaaattttttcacatttttttcttttacatttcatttamacgtacttttctttttatatctccggtca

SEQ ID NO: 214 - DNA, 401 bp, Artificial Sequence
  Consensus Reference Sequence
ttgtaattgaagttgcatcattcactttaatttgtcrgcaatatcaaaaaacaagaaattgctaccataattacaatttaaaactttggcaataasaattrggcgtggtagtatatgaagagaaaatcaaagtctggatggagaactttgaaaaggacatgccactataaaagagctttttatttaaaaataataattttataktttttagtttttttttaactaaaaaaactcaaattttttcacatttttttcttttacatttcatttamacgtacttttctttttatatctccggtcacatcttttttttttcttcttatcttgttttttttcttctctatctttcatacacasatctcacatttcacgagtgtgagaaaattattattttttaaaaa

SEQ ID NO: 215 - DNA, 401 bp, Artificial Sequence
  Consensus Reference Sequence
taattgaagttgcatcattcactttaatttgtcrgcaatatcaaaaaacaagaaattgctaccataattacaatttaaaactttggcaataasaattrggcgtggtagtatatgaagagaaaatcaaagtctggatggagaactttgaaaaggacatgccactataaaagagctttttatttaaaaataataattttwtagtttttagtttttttttaactaaaaaaactcaaattttttcacatttttttcttttacatttcatttamacgtacttttctttttatatctccggtcacatcttttttttttcttcttatcttgttttttttcttctctatctttcatacacasatctcacatttcacgagtgtgagaaaattattattttttaaaaatta

SEQ ID NO: 216 - DNA, 401 bp, Artificial Sequence
  Consensus Reference Sequence
  misc_feature 173: n = A,T,C or G
tttttcacatttttttcttttacatttcatttamacgtacttttctttttatatctccggtcacatcttttttttttcttcttatcttgttttttttcttctctatctttcatacacasatctcacatttcacgagtgtgagaaaattattattttttaaaaattayttcttngaaacatcaagaatatattgcttttwccgtaaaaaaaagaatatattgctttttctgtttgactaaattttgtctttagtgagtgaaattaaataaccttaattattttattaaatttagaatattcaacagcttattttaatttttgtaaaaaaaaaamagattattttaatttttaaacataatcttgaatgacaatcattttgagactgaagggagggagtaatt

SEQ ID NO: 217 - DNA, 401 bp, Artificial Sequence
  Consensus Reference Sequence
tttttctgtttgactaaattttgtctttagtgagtgaaattaaataaccttaattattttattaaatttagaatattcaacagcttattttaatttttgtaaaaaaaaaamagattattttaatttttaaacataatcttgaatgacaatcattttgagactgaagggagggagtaatttatgtaacaaagttcgcacgtcgacwcctttgatcctttaattttctttttcccacattgtagttttttttggtagattttctcaatttaatttaawgtttaagctayaaacttgaaattgttagttctcyaataaatataatgtttttttcaaataactgaaaatggctgttgaaaagtgaataattgtgcagattaaattatttttaaagtttattattg

SEQ ID NO: 218 - DNA, 401 bp, Artificial Sequence
  Consensus Reference Sequence
  misc_feature 105: n = A,T,C or G
ggatagagcaactaaaatttaagttttatartcatcatcaaaaaaaktattagtttttataaaacaaaaaagtctcaaatstacctaaaatattcctatataatnwtaggaaaataccttccaaaattaatgtttaattttttatatcctgaaatacaaaaatttaaacatcattttaagatgtaytttccagacagacacacaattataggtcytgaaaaatattttcytgaatacaattttaagtttgtattcargaaagtactttttagawgtcaaaaaattttaaaaagtaytttttggaatttaataaaaaarratatgttacatttattytaaaatctaaaaagatratmatttcaataaagtgrcagataaakaaagtattaatgtctwtactc

SEQ ID NO: 219 - DNA, 401 bp, Artificial Sequence
  Consensus Reference Sequence
acacaamatgtgtaaaycatgtatgaagattcaaarcttgtaaatacttttcctaatktgtattaagataataaagttatcaaataaktaaayccaagaaggtgaggaagaaadgaatgttttgttgtcatgaaagtaaaaattggartsaaaaaaaggaaagattctaatgaaagaaaggraaaatattttgttgtcctaaaaggagtgcattgttgggagrgrgggggggggggagtgtatgatggtgtgaggaaaataaaaagatttdagatragactcctctttgtttttgtggaattatgacaatcggtagrgtcctataatatctttcctcgtatmtatattttgaaaaaaaacacctrtagccgatgtcatacctgtgcgggtaacaactttaa

SEQ ID NO: 220 - DNA, 401 bp, Artificial Sequence
  Consensus Reference Sequence
rgrgggggggggggagtgtatgatggtgtgaggaaaataaaaagatttdagatragactcctctttgtttttgtggaattatgacaatcggtagrgtcctataatatctttcctcgtatmtatattttgaaaaaaaacacctrtagccgatgtcatacctgtgcgggtaacaactttaatcttcattttttacttccatgacaacaaatcattcctttgracctcacattcttggtttagytatctaatagatttattatctttctacaaactaggaaaartgcttacaagctttgaatattcatatatggtttrcacatgttgtataattaggttagakattyaagtaktggagtatagatacawtgaatgctttctttgtctgtcactaattatcatct

SEQ ID NO: 221 - DNA, 401 bp, Artificial Sequence
  Consensus Reference Sequence
tacaagctttgaatattcatatatggtttrcacatgttgtataattaggttagakattyaagtaktggagtatagatacawtgaatgctttctttgtctgtcactaattatcatctttttggattttgraataaatgcaacatgtkttttttccattaaggtctagaaattacttttcaatttttttttacttctagaaagtactttycraaatacaaaattaaaattgcattcaagaaagtattttctaraacttataattatgtatttgaaaaggtacattttgaaattgatrtttgattttttgtattycraatgaaatataaaaaattaaatatcaattttagaatggacttttytaaatgatgatayagaggtataatgaatatttatacyagtaa

SEQ ID NO: 222 - DNA, 401 bp, Artificial Sequence
  Consensus Reference Sequence
ctttattgccaaacaataaccattggcggaaaaagcacatttaaggtccaacacaaaggttactggctcctaacctaaaagatggtgggaactgattgggacactaaaatactggtacatcaacattttttttaaataccaaaaatgtccttaygaatattttttattacaaatagcagatcagyttttttattwatgcactgtcttcttttttttttaaatctcactcccttaatataacttaatgtaacttgcttarcatctttatgtgagtgtttgttgtbtagtggtgcatgtaygttgttttcggatatacgatraagttcattgattttttcatcgccrgagaagaacaagttcatattaaaaaaattcaaaacatacatattgataatcyagat

SEQ ID NO: 223 - DNA, 401 bp, Artificial Sequence
  Consensus Reference Sequence
  misc_feature 309: n = A,T,C or G
tcaacattttttttaaataccaaaaatgtccttaygaatattttttattacaaatagcagatcagyttttttattwatgcastgtcttcttttttttttaaatctcactcccttaatataacttaatgtaacttgcttarcatctttatgtgagtgtttgttgtbtagtggtgcatgtaygttgttttcggatatacgataaagttcattgattttttcatcgccrgagaagaacaagttcatattaaaaaaattcaaaacatacatattgataatcyagatggttcatacggattgtcaatccatatnttttgaatttttwaaaaaattataatttttttatamtcttttttatacatttaatttatttacaaaatttgataattaaacaaatttgatat

SEQ ID NO: 224 - DNA, 401 bp, Artificial Sequence
  Consensus Reference Sequence
  misc_feature 57: n = A,T,C or G
aataaataataaatgacttgcctcgagccaacacagagggttaaacaaattatcccntcaattcaattaaaatttttwaaaaaawtatttttttaaaaagaaagaaaattaaacaaagaagcattttwwaaawaaataaatttgaatagattaaaaaaatatyagttaaattaawttttttcaccatccacaacaacacccrcaacaagacatattactacaatraatttacatataataacaaaattttaaaaaataatattacaamacaatagattattttcktmagtgagttwgattgatcaactttgaaatctgaaaataatattgttggycgaattgttcaagctggttatgagttgtgctggtttgcacccatcaactttgaaatctgaagcaga

SEQ ID NO: 225 - DNA, 401 bp, Artificial Sequence
  Consensus Reference Sequence
taaaatttttwaaaaaawtatttttttaaaaagaaagaaaattaaacaaagaagcattttwwaaawaaataaatttgaatagattaaaaaaatatyagttaaattaawttttttcaccatccacaacaacaccyrcaacaagacatattactacaatraatttacatataataacaaaattttaaaaaataatattacaaaacaatagattattttcktmagtgagttwgattgatcaactttgaaatctgaaaataatattgttggycgaattgttcaagctggttatgagttgtgctggtttgcacccatcaactttgaaatctgaagcagaagcccaggaacaagarcaagctaacatgraacattcacccatttcacaaccaatcaccacaaggtag

SEQ ID NO: 226 - DNA, 401 bp, Artificial Sequence
  Consensus Reference Sequence
atttcacaaccaatcaccacaaggtagcttgttgactccccatatatatagtgcattcctagaaccttgaggacctcgtgtgaattgttatctctttyttaccgtkgtaatttcagtgccattagtgtcctttttcattcctagaagcttccaggagttgttgcctgttgttggtgacatctctcaaatttgggtttaatagtttgtattaattartcatttatgaatgtgaatggaagcacwgaaattttatattttcttaatttttttcttttttctaaggagatctgatctcaytcttgaatttgkgatccttgaagagcttatcagttatctgtaccaaaaaaaaagtctgtccatgcatttaataaattttattgttgtttatgtaagcgtaacaa

SEQ ID NO: 227 - DNA, 401 bp, Artificial Sequence
  Consensus Reference Sequence
tyttaccgtkgtaatttcagtgccattagtgtcctttttcattcctagaagcttccaggagttgttgcctgttgttggtgacatctctcaaatttgggtttaatwgtttgtattaattartcatttatgaatgtgaatggaagcacwgaaattttatattttcttaatttttttcttttttctaaggagatctgatctcactcttgaatttgkgatccttgaagagcttatcagttatctgtaccaaaaaaaaagtctgtccatgcatttaataaattttattgttgtttatgtaagcgtaacaagtgcagatggtcgatcrgcatccttaacatgttaacaaacacaaaatatcaagatgcacatattgaacatggacttcatcatcaatgtcagaattt

SEQ ID NO: 228 - DNA, 401 bp, Artificial Sequence
  Consensus Reference Sequence
attattaaaattaaactcaattaatatttcccaattgggtatgacaaacaaacttgtaccggrcggatatcactccacccctatctcgagtttgatgaagaatttccactttgacgakaaatggatacgggttcgagtaatacttgattttttagaaatagggataggaatgggtaagtacatatttgctcagtgtaaatcatctctattttgtatgttgttcgktaatcaacactcactcaaataaaattatgcacacacataaaggatcgtgagaacacaacaaaaattataagattgtaactcaccctaaatagtatatcactttacgaattccagtattycacttagtgattacaaraaataataacactcayacaaaaatatttttctcccaacaa

SEQ ID NO: 229 - DNA, 401 bp, Artificial Sequence
  Consensus Reference Sequence
tatttcccaattgggtatgacaaacaaacttgtaccggrcggatatcactccacccctatctcgagtttgatgaagaatttccactttgacgakaaatggatacgggttcgagtaatacttgattttttagaaatagggataggaatgggtaagtacatatttgctcagtgtaaatyatctctattttgtatgttgttcggtaatcaacactcactcaaataaaattatgcacacacataaaggatcgtgagaacacaacaaaaattataagattgtaactcaccctaaatagtatatcactttacgaattccagtattycacttagtgattacaaraaataataacactcayacaaaaatatttttctcccaacaaagtaactttatttaaaaaatctct

SEQ ID NO: 230 - DNA, 401 bp, Artificial Sequence
  Consensus Reference Sequence
cgtatgtatagcagacaagttattcaatgcatcaaatagctaaagttaatatgatagatgatatataaatgtaagtaattaagatttgatgagtattagaagaaaaaataattgatgagattacttaagaatgtacatatamtcttgacaaaagatacagataatatgctataagagaaatagatgaattaattaatgtacattgtctaatcacatcattttaaaggaagaagaaagtgtttcatttgatgaaatatcatttagtcattgtctgacattgactgtttaggtcatctcactccamgcttcttcagcgtgattcaacttgattaagtcacaagtcaatcattgatgcaaataattttttttctccatgtctactaattaaaataaaatgtgat

SEQ ID NO: 231 - DNA, 401 bp, Artificial Sequence
  Consensus Reference Sequence
  misc_feature 163: n = A,T,C or G
ttgtctctagatgtacaataatggaatggctgattgaatagtagttgmcacttgacactcaaatctacttataaatcattaattaaaagtataacaacttttctgcgtgacctataattaaatcaatatctatttgggtaacccaattcaaatataatataancatttttgggagagttaatgaggtctgcagaactcataatctgttattatacttttttaatgctgggtatttcttatgcccaattattatttataayagatatacttttgctgawaaaaaaaaaahmaatatctatttccattaaactccaattttcaaggttcaaatgttcagagatacaaatgcacaagtctccaagtccaccggasatggaatgaaggaataaatcttgactgac

SEQ ID NO: 232 - DNA, 401 bp, Artificial Sequence
  Consensus Reference Sequence
ttttaagttgttgttgttgctgctgctgctgcatggttattggcagcatcatggaggtgtacattttcatccaattcatcatttgcacttgcgcttgcaattgcttcatatattggatcacctcatctagcatcgaagctttatcagtctgcaaaayaaacaagggttatrttgtaaaattatatggcttaaataattaaatyttttttttgtargagatcatattatgcatatcctttgttaaaaataatcatattcgagttaattagattattattatgaaagrcaattttctctcyaatattaatattwtcgagtaatcatataatactagacaaaatttwctttgcaatataatgtaattcatatcaaaaacttaaactcgagaatgataattaaac

SEQ ID NO: 233 - DNA, 401 bp, Artificial Sequence
  Consensus Reference Sequence
tgttgctgctgctgctgcatggttattggcagcatcatggaggtgtacattttcatccaattcatcatttgcacttgcgcttgcaattgcttcatatattggatcacctcatctagcatcgaagctttatcagtctgcaaaayaaacaagggttatrttgtaaaattatatggcttaaataattaartyttttttttgtaagagatcatattatgcatatcctttgttaaaaataatcatattcgagttaattagattattattatgaaagrcaattttctctcyaatattaatattwtcgagtaatcatataatactagacaaaatttwctttgcaatataatgtaattcatatcaaaaacttaaactcgagaatgataattaaactacaacaatgtatc

SEQ ID NO: 234 - DNA, 401 bp, Artificial Sequence
  Consensus Reference Sequence
yaatattaatattwtcgagtaatcatataatactagacaaaatttwctttgcaatataatgtaattcatatcaaaaacttaaactcgagaatgataattaaactacaacaatgtatcaatcggatctaaaagtattatcttatcagtagtcagtagaggattctcaccaagatgtgtagacatagagtctaattgtctttctgttagtaactcaattattaatcaaaagtgaaacctttttatttcgarcaaacttaaagattgaaactgaattttgtcatttaggcacatattcctttaagaagttcttcaaagagayataaaaggattccaattgatttctgaaatgcgtttgctttatgagaaggccaatcctatgcagacacaaaatgaaacatata

SEQ ID NO: 235 - DNA, 401 bp, Artificial Sequence
  Consensus Reference Sequence
atcggatctaaaagtattatcttatcagtagtcagtagaggattctcaccaagatgtgtagacatagagtctaattgtctttstgttagtaactcaattattaatcaaaagtgaaacctttttatttcgarcaaacttaaagattgaaactgaattttgtcatttaggcacatattcctttaagaagttcttcaaagagacataaaaggattccaattgatttctgaaatgcgtttgctttatgagaaggccaatcctatgcagacacaaaatgaaacatatactatawggagatgcgatatrtgatctgggsttcatggcattgtgtcctcatgggaccactgaaccgattaattggtgaacagggaaagaaattaaagagaggatcaatgttgcagctt

SEQ ID NO: 236 - DNA, 401 bp, Artificial Sequence
  Consensus Reference Sequence
aatcaaaagtgaaacctttttatttcgarcaaacttaaagattgaaactgaattttgtcatttaggcacatattcctttaagaagttcttcaaagagayataaaaggattccaattgatttctgaaatgcgtttgctttatgagaaggccaatcctatgcagacacaaaatgaaacatatactatawggagatgcgatatatgatctgggsttcatggcattgtgtcctcatgggaccactgaaccgattaattggtgaacagggaaagaaattaaagagaggatcaatgttgcagctttatcatgttacgtatggccactttcttacataatagagaatttgaaaaaagattgggaacataattttataccaaaaacttggctaagttacaaccattctt

SEQ ID NO: 237 - DNA, 401 bp, Artificial Sequence
  Consensus Reference Sequence
gaaacctttttatttcgarcaaacttaaagattgaaactgaattttgtcatttaggcacatattcctttaagaagttcttcaaagagayataaaaggattccaattgatttctgaaatgcgtttgctttatgagaaggccaatcctatgcagacacaaaatgaaacatatactatawggagatgcgatatrtgatctgggcttcatggcattgtgtcctcatgggaccactgaaccgattaattggtgaacagggaaagaaattaaagagaggatcaatgttgcagctttatcatgttacgtatggccactttcttacataatagagaatttgaaaaaagattgggaacataattttataccaaaaacttggctaagttacaaccattctttctttacctt

SEQ ID NO: 238 - DNA, 401 bp, Artificial Sequence
  Consensus Reference Sequence
aagttgaataaaataatttattttagtacatatggtwyggttataattttttatgtattatatggttatgaaytgtaagtagaaaaagttgatgttattgatttttaatttataggattatcaattttaatgttttataatattatatgcaataaaaaattacgtaggattttatgtgatagtatgtgtatggtgtggttaggggttatttgtttgtgatgttgaaattttttaatgtcttgttaagatggacgaagaycaatggatgtatgacagtataatgtctgaaaaagttgatatgaatgaacaaaataaagatgaagctggtgtgaatgaagaacatgttgattgttctgatgcttttaatacttcttaggtaataatgtaatttattgttatta

SEQ ID NO: 239 - DNA, 401 bp, Artificial Sequence
  Consensus Reference Sequence
gcaaaggatggatggtraagttaatgtatgggagtcacaatcatgaaatgacaaagtcattagttggacatcyatatgttggtcgatagactaagaatgaaaagacaagtattgttgatatgacaaagtcaatggtgaaaccaataaatattctrctaacgttgaagaagcacaatgttagtagttgtacaataatcaaacaaatatacaatgcaagaagtgcataccgttcttccataagagacagtgatactgaaatgcaacatctaataaagcttcttaaaggagatcaatayattcattggcatagattaaaggwtgaagatgttktacgcgatatcttctggygtcatcctaatgcagtgaagttatgcartgcacgtaatttgatatttttgata

SEQ ID NO: 240 - DNA, 401 bp, Artificial Sequence
  Consensus Reference Sequence
agtggaaatttcargcgggttgcttggggactrgatgtaggcacagggcgtggccaaaccartataaaaactgagtttgtattctctcttcccttaaacttatgttatttattattctttatattttgctttaaagaagtttgtttttgaattgttcttagagtaattcataataagggttgcattgttaatcaaaaagaaagttaaattttaattgggggatagcttgtgtatcttaattcaaccctctttcttaagataattgaggtyacttgtttaacatttgggatgccatgaacaacatgatcatgctacaacacaytgaaattaaggcatcttttgagacaagtatacatgtgattgrgcatgkttttaaagttaccttatacaagaggttactt

SEQ ID NO: 241 - DNA, 401 bp, Artificial Sequence
  Consensus Reference Sequence
ccttctctggtcagtgtatgaygacaacgggaccccatcggatatgtccagaaaaacatgaaataaggtcaaactttctaactacacggtggtcacygtaaggcatccaacaaacatcagcagccgtcagtcaatctagatgcttccgattcgtcratgctggtaatgccttcgtagaggctttcatagaggttcagcgacaggcacrtggtgacctttcatcatagtcttcatccgtaaaagccttagcaatagatgaaaaatactcataaatycaacactamacaaatttcattagaacaaaaaaaatatcaaatgaacatattaaaaaaaaatttaaataacattcaatgacaattacccataatagtgtgatatatccaacaagttgtctgttgccr

SEQ ID NO: 242 - DNA, 401 bp, Artificial Sequence
  Consensus Reference Sequence
tataaaaaaacttttactattaaaaaaataaatataattaatttattaataattaaaaaatacatacaaattacataatccgtatgarttatacgaattacttaatcygtataacrcatgtaattcgtatgtartatatagaatcaaacttacytcaacgatagaaacaacacaacagcgwggagacgtcctcaaacccgacaatacaagwagccaacaacagtggcaacagcgaggaagacgaakcaacaacactagggaagaatatgacacgaacggaggaacagtaatgcaaggagaaagggtttttaaaatttaagtraaaggatattttactacttcacttaaatttggatgcaccagcaataatactgggtgcacctaacaacacccctscattg

SEQ ID NO: 243 - DNA, 401 bp, Artificial Sequence
  Consensus Reference Sequence
aagaaggtttccatgtttttcctttaccatgtcacagtatatatagtgtggtcttttgtttctggtttgcttgtgtaatttcgctgcatgcactttctccaaactaataactcttttttctttactaaaaacactgtgttgtgtcaccccwcttgaatcaatattcaaagcttcttctgctgctcctctgtgagtgcaatgatcaccattcagccttggaaattctgaagtttgtaaagcagaaagtgagttagctgaagttgttgctttactttgttttgttctcttaatttttttaatttttttcaccctcacttggttactgtcttctcttctgtctagtctattcctttstttgtttttactgctctttctktttatatacaccgagkatttgattg

SEQ ID NO: 244 - DNA, 401 bp, Artificial Sequence
  Consensus Reference Sequence
tttgtgcatcacaagtgccctcaaaccgtcctgatatggcwgaggtaatcaacatattagagttgatccaatgtccttcagaggaattacaatgaattttaagttattataragattgaaacataacacatattgcaatatacacctggtgaagaacaatccagtttgatagctttaatgctatacaataktataaacyacgcaaagaatattcagtcaaatttctttcacaamttttgtttgttgtttcagttgtaagtttttccttttctttttacttttggtyatttcaagttgtactactggatttttcttcaccagtttggaacctaatacaatggygtttcaatcgtacttgtttttttyccccctacaaatcaggaattgcattttctaaacat

SEQ ID NO: 245 - DNA, 401 bp, Artificial Sequence
  Consensus Reference Sequence
atatggcwgaggtaatcaacatattagagttgatccaatgtccttcagaggaattacaatgaattttaagttattataragattgaaacataacacatattgcaatatacacctggtgaagaacaatccagtttgatagctttaatgctatacaataktataaacyaygcaaagaatattcagtcaaatttctttcacaaattttgtttgttgtttcagttgtaagtttttccttttctttttacttttggtyatttcaagttgtactactggatttttcttcaccagtttggaacctaatacaatggygtttcaatcgtacttgtttttttyccccctacaaatcaggaattgcattttctaaacatgaatattcgtggcatttttgtttggtttatgtt

SEQ ID NO: 246 - DNA, 401 bp, Artificial Sequence
  Consensus Reference Sequence
attacaatgaattttaagttattataragattgaaacataacacatattgcaatatacacctggtgaagaacaatccagtttgatagctttaatgctatacaataktataaacyaygcaaagaatattcagtcaaatttctttcacaamttttgtttgttgtttcagttgtaagtttttccttttctttttacttttggtcatttcaagttgtactactggatttttcttcaccagtttggaacctaatacaatggygtttcaatcgtacttgtttttttyccccctacaaatcaggaattgcattttctaaacatgaatattcgtggcatttttgtttggtttatgttcttctgggacaaactgtgcttcatgttggtacgaagcccacacaacygattw

SEQ ID NO: 247 - DNA, 401 bp, Artificial Sequence
  Consensus Reference Sequence
ggryattccccagtcaatagacaaaaascaattctttcatgtggtaaaaattatcaaaataaatttkatttcttccaacaattttttttatatataattagaaatcgaatccttaataatatactttaaaaaatctactaactttattaratcttattgattgatrcatactcatctaacaaaatatgtacccgaaggatcttttatwtatccaccaccatttaatttatatagcamattctccaaaaatttcactgattggacaatgttaaaaaattwgaatcacattcctagctcacactgaaaaggcttccttctctatcctaaaaaaaaaaaagtcaaaaacaagrtttttcatttttwaawatttttaaaaatatttttcgtaattaaaawtaaat

SEQ ID NO: 248 - DNA, 401 bp, Artificial Sequence
  Consensus Reference Sequence
ccccagtcaatagacaaaaascaattctttcatgtggtaaaaattatcaaaataaatttkatttcttccaacaattttttttatatataattagaaatcgaatccttaataatatactttaaaaaatctactaactttattaratcttattgattgatrcatactcatctaacaaaatatgtacccgaaggatyttttatatatccaccaccatttaatttatatagcamattctccaaaaatttcactgattggacaatgttaaaaaattwgaatcacattcctagctcacactgaaaaggcttccttctctatcctaaaaaaaaaaaagtcaaaaacaagrtttttcatttttwaawatttttaaaaatatttttcgtaattaaaawtaaattaarrgg

SEQ ID NO: 249 - DNA, 401 bp, Artificial Sequence
  Consensus Reference Sequence
arttytaaaatgcatcttatgttttggattacttaatacttttttatagataaatgttaattrttartttgttaattttgtgttaacatgagagattgaatctgtgatctttttctcattcttttcctttttaaccatccaatcaaccttatatctatagtattttaaaaytatactacatgacctctggatcatctattccagattatgctattaaagtttcaaattgagtaatctagaacaaaaaatacattctarattactmaatatggaactatatatatgaaagtgayaagaggttgtwacactggtgtaagaaaggatagacaygaaggtagcacgaagrgagagaaaaattggatttggaggttgtggtggcgacacaaggaagaagaggcaat

SEQ ID NO: 250 - DNA, 401 bp, Artificial Sequence
  Consensus Reference Sequence
attttttcctgacaaagatattagtttttatttttagctattgtgatttttttatgatgtctctaatatttgtttttttttwgtcttttctactagcctctatwgtaaaaatgcttatgtaactrggacagtgcacatctaccaggaatgygaattacagattacactgggttttattattcarctygtagctayacargattttttgtgtagtrttttgtcaccactagtgaagttagctggttctactcttgcaagttacaaataatgtgagtctttaacaacacactatagtacatarttcaaaggaaaatgacatgytccaaatcaattcttttgggttgaaaagggaatagttaaaatagcatttagcaccactatttcattttgtcatggtcact

SEQ ID NO: 251 - DNA, 401 bp, Artificial Sequence
  Consensus Reference Sequence
atgactgtaatgactgtcgaataatgaaagaagcatgcmttgtcttgaamatgatcaaatgcaaattctacatacactttgtattttttcttttgttttcatgttagagttttactttgtttgcttatatagttatatggatgarttaagtttttwgtscttaaattatgagrttttgaaaatcagtctycaaagaatttayygttattaaaaataatatctayaattaagtgataaaatgtcatgaaataagatttgattaaatgtcacatgtatatcacatacatgttaagtaagttwtattatatttcgataaataattataatattatgttattaaaatgyaaaaggaaaaaagaagaatyattgttraattctaactctcaaagcacccatgagra

SEQ ID NO: 252 - DNA, 401 bp, Artificial Sequence
  Consensus Reference Sequence
tryygttattaaaaataatatctayaattaagtgataaaatgtcatgaaataagatttgattaaatgtcacatgtatatcacatacatgttaagtaagttwtattatatttcgataaataattataatattatgttattaaaatgyaaaaggaaaaaagaagaatyattgttraattctaactctcaaagcacccatgagaagatctgcaacgcrgagyarcaattcatcctcatcatttataatctatagtaatartgatattcgtggtaaacacttaatgcttaatatagattattaatgataaagaatatttataataamraaaaattatttaaggatcaaatatttttttaaaaatagtttaaggatyaaaaattcaaaactccayaatttgaggac

SEQ ID NO: 253 - DNA, 401 bp, Artificial Sequence
  Consensus Reference Sequence
taataamraaaaattatttaaggatcaaatatttttttaaaaatagtttaaggatyaaaaattcaaaactccayaatttgaggaccaaaaacttaattaaccttgatsattgaatttatcaagtttattaagtgtaattactaaggaaataatttgttttaaaataggcactygctatttacaccacaatttttgttaagcacayccyattcctcctttttttatattttaattattcattrtatcctttttccttaaagaratatactccttggagatcctttttrttttctaraaatrtctctcaaataatatatacttattytgaaaatgtktctcattattttaattgctcattatacaaaawgatatatccattggaaaccttttttttttccaaa

SEQ ID NO: 254 - DNA, 401 bp, Artificial Sequence
  Consensus Reference Sequence
atttctaatattagaaaattaacttttatcttatattttataccttatgttgtgagtyttattttcattatatytttaaaatttatycaaaatattattttcatcatatctttattattttttaaatccdaattttgtrttacatatttattatataataatgtatgtattacatttaatattatacgtttttttcacatagcattatatttcaaggtatgtttcattttttttattattattattttaaattgagaaagagcgtataaaraktgttgttaacattcccaagtctaagaggaaatgtggtagagggagattttactgggattattcggttgacatgtgaaagatagggactccaaacggraattattttgtatatagtataaatacattta

SEQ ID NO: 255 - DNA, 401 bp, Artificial Sequence
  Consensus Reference Sequence
atmtatttagctcttacagttggaytcaatcaaattcagttcatatacaaaattarcgtgacccgttattttttattttgctgaataaaaaaattaaaaaaattcaattcaaaccgttaaatakaagtaaaatatatatctaaattaaattcaaccattacaraaaaaaaaagtatgtttgagtgttatatccaaagaaaccctgctacatgtttggttaggaagggraaaaaaaagaatrcagatatctatttatttttccttctatttagttaaaaagaatgtaaaaaatcactttttaaaaaccaagttatattttttcttaatatatttattataaagttytatgtttaaaattaatttattaaatatawtttgttayaaaatarttttaaattaat

SEQ ID NO: 256 - DNA, 401 bp, Artificial Sequence
  Consensus Reference Sequence
agtttaacaaccttgaatrattcaagtaaaataatcctactrragatcttatgtgcaagtgcaacgaaacayacacaaaagtacatattaaagatttaacaatatcataaatttaaataattttaaatatgataragatcayaaatatcattgatgagatacaatcttactcaatgtcattatggaggtcaatgttcctaccctgagtagttaacacaaatgcaaaccaaaaattcaataataattatttttatttttaaattctataaaatcatttttaagtaaatatataatagatatattaaaattaatatattagtcccggttcatcyttgtgtatgaaataaattggaatgggagggaaatagtcaaattatgtgcactcagaattctggaggaag

SEQ ID NO: 257 - DNA, 401 bp, Artificial Sequence
  Consensus Reference Sequence
  misc_feature 284: n = A,T,C or G
twatatgtagtaataaaaatattaaaatcaatttataaaatgtatttttattacaaaatagttttaggttacttactcaatatgctctttcttcaaatatttcacacaaattcatatcaaagacttaataatatcataaattaaaataattttaatcatgacagggatcttaattatcattcatgagaaataatcctactcaaaatttttacaaatgacayagttctttcgccgwgtagttaacacaattgtatatcaaagagtaaaaataatatttttttttnaaatttgaaaacccatttttactttataatcacttttacataatatataataactactaaaatttaattattaaatataatttttaatacaatacttttaaaatrcttactcaataa

SEQ ID NO: 258 - DNA, 401 bp, Artificial Sequence
  Consensus Reference Sequence
  misc_feature 398: n = A,T,C or G
cactgatttattttctgttcttatcatgattggttycacattattattatgtcatgcacttcatcatgrtgtgttgcactaatattaatratcgttctacaaatctttgttgtaccccttaaatttcattrgcttctgycttttttttctkatggaaattaattaattaacattgatttttgaagtgcttgttrattacrggcaccatggaggaaagagtggggcttttgtttctgattttttcatgcaagagaggtaacaattgttagattggcctttttyttatctttttgcttttaaatttaattatcgtgctaagtkagatggatataahrtagttacaacctcacacyaaayttactgtaccataataaagtttayctggttcttgtagtaanaat

SEQ ID NO: 259 - DNA, 401 bp, Artificial Sequence
  Consensus Reference Sequence
  misc_feature 362, 369: n = A,T,C or G
tcttcaatttaccgaattgcaattgtatatttatyatgcttttatcaattcttayrtatctacatatctatcatatttttakaataatcataccactattaatttataggacagaggataagagataagctgaaaycatccaatmcttctgaagttcacttgrtacaccttttcatcyttyacatygtasccaacgaaaaacctcacaaatgaaaattcaactattgagaaartgtcaatttsacgtcaattaaatcaaaagttacatttagcactagttyawatttgaacttarattcatgrrtargtayagtttctccrggccaatcaayyatatctgaaaaacaaaaataartttcccncggtcantttcactctggcctcaataatcttaaagataa

SEQ ID NO: 260 - DNA, 401 bp, Artificial Sequence
  Consensus Reference Sequence
  misc_feature 293: n = A,T,C or G
gaacagtttggactacagatgctgttttttcactgcgggttgttagaagaattttacttctcctaataatcccacggttaaatggtttcttaagaagacgccaatcaacataatcctctgtccaaacatcatccaaracaattaagaattttttatctttcagyttgtccatcaattcaagatgaagtarattcagatcactmaatttacaagcctttccagtcaccgcctctattatagtttttgtgaccttgagaacatcaaattcttgagaaacacaaacccatgccttnaaatcaaartcaaatatctgtttcaaattctcatcrttgtacaccaattggrccaaagtagtttttccaaccccacccatgcccacaataggaaccacagacacttcw

SEQ ID NO: 261 - DNA, 401 bp, Artificial Sequence
  Consensus Reference Sequence
agatcattgagccagtgtttgacattggtgtttgtgatctgtttcttctcggcatcatcaagcacagctccaaccaytctgagagtgktctccaacttttgaagcaacttcttgctaagcttctttccacggatcaggtcaacaaagtcaggtgaagccagcctgtygaaaagcacatcaaggaaagcagagagaaaggcaccacckaccagtgctgcagccatkatctcaagaacaaaagatgatcagagtagaaagwmaaaggcaagggaattggttgctaygaactgggttggttcttggtaaggttaactgatgtgatgagatttggcttaaktcaactstcttcaccttcactcgttctgctgtgcaagacaaaagtatggtcttttttatttgta

SEQ ID NO: 262 - DNA, 401 bp, Artificial Sequence
  Consensus Reference Sequence
cttaaktcaactstcttcaccttcactcgttctgctgtgcaagacaaaagtatggtcttttttatttgtattattatggtggtgggtgacttatcrcgttkkgagtctctttmctkttccccacatttaaaaagtgatgatatttctaccgttaatttaaaaaaaatggattatatttctaaaatgctwtaattaaagttagtgatggccagctttytygctttccaaaycgtgtggagcagtggtgtgtgtttttttcttggtgatatgtgtggatggctgcaagggtactgtgcrtaattawgttcctgtgctttratgctgwgacaagttgtattgaagcagtttgcacatktgttttggatatttttatttwaaaaataagttaayagtaaaattga

SEQ ID NO: 263 - DNA, 401 bp, Artificial Sequence
  Consensus Reference Sequence
  misc_feature 325: n = A,T,C or G
agttatgtaaagatcctcaacttagaattttttttctaaagttaaaatttaaaatbaatttttcaatrtgaaagtaaatagtgaatatttayttaaattygtgttagtttatatttcaayctaatcattaaaattgtcatagagatatgrtattttataaaratytaayactgaatcatgattttataaatttaaaatractrataatratttatgttttttaatcaagtgrtawaagatttaaatytttattaattcttatatatakaataaattttgttargaggaaaataaaaaaatgagattaaaaaattattaagacaanaaaaatgttgaamaaattaaaagagaaagaattaaagaaaggacacatgctaattgatccctaaaaayataatatt

SEQ ID NO: 264 - DNA, 401 bp, Artificial Sequence
  Consensus Reference Sequence
gggaacccaacttctctttgctcctattattttttaatttaaaaaaatwattaaattcattttttatatattttttaaaataaaaacccttgagcttccttctacttctatagtctctaccaagaktttgytrctttattgcttttaattatctccaaactttgaatggcgggagccgttgggagagaagagacaagcagctcgcrattactaatataaagtgatattagagattcatataataattaattagttttaagaaatatttaatttcagttttttgcatttaatttaattaatttatatgtaaaattattcaaaatattatttataaactttaaatattataaaaatyaatttttatttaaaaattaaagtataataattgaatcattttatca

SEQ ID NO: 265 - DNA, 401 bp, Artificial Sequence
  Consensus Reference Sequence
cccaacttctctttgctcctattattttttaatttaaaaaaatwattaaattcattttttatatattttttaaaataaaaacccttgagcttccttctacttctatagtctctaccaagaktttgytrctttattgcttttaattatctccaaactttgaatggcgggagccgttgggagagaagagacaagcagstcgcaattactaatataaagtgatattagagattcatataataattaattagttttaagaaatatttaatttcagttttttgcatttaatttaattaatttatatgtaaaattattcaaaatattatttataaactttaaatattataaaaatyaatttttatttaaaaattaaagtataataattgaatcattttatcattcat

SEQ ID NO: 266 - DNA, 401 bp, Artificial Sequence
  Consensus Reference Sequence
tattagagattcatataataattaattagttttaagaaatatttaatttcagttttttgcatttaatttaattaatttatatgtaaaattattcaaaatattatttataaactttaaatattataaaaatyaatttttatttaaaaattaaagtataataattgaatcattttatcattcatattttaaaattaccataacattttaatttaatataatttatgtgtttaaatttttatayaaaaaattctcatataattttataaatacgcgcgtgaatttattattaaatatatgtttcgtgcataacaagagagttraataartaycgagtgtcattgttattctttcaaaaattagagttcaactcttgasatctttccaycacctcacttagtcgc

SEQ ID NO: 267 - DNA, 401 bp, Artificial Sequence
  Consensus Reference Sequence
atttaatttcagttttttgcatttaatttaattaatttatatgtaaaattattcaaaatattatttataaactttaaatattataaaaatyaatttttatttaaaaattaaagtataataattgaatcattttatcattcatattttaaaattaccataayattttaatttaatataatttatgtgtttaaatttttatacaaaaaattctcatataattttataaatacgcgcgtgaatttattattaaatatatgtttcgtgcataacaagagagttraataartaycgagtgtcattgttattctttcaaaaattagagttcaactcttgasatctttccaycacctcacttagtcgcagcatctgacaatatttaatttataagtaatgttttcagt

SEQ ID NO: 268 - DNA, 401 bp, Artificial Sequence
  Consensus Reference Sequence
gtttacagttcgtgtgtttcatgccaatatataattttcgtaaataaattgcacgaatcctttgcatcactcatatatacaagtgctgcaacttgttatcacctacttgactagtcacatatrtttaattttaacaccaatttgaggaaaaataaattktaaraattmttttttgtcaaatctgcacgaggtgtgattatgtcaaaacctatttggtatttttaatgaatattagtttttaaaaagttgttaataagtcaggtataccctttagaatctatagtttacggtttgtgtatggaaaatataatgctgtgttaggaaagaggattttgtaaaagtcgcmcgaagtttgatgtctgtaaatctctttttacatgcyttttaaatttttttaatcg

SEQ ID NO: 269 - DNA, 401 bp, Artificial Sequence
  Consensus Reference Sequence
ggaaaaataaattktaaraattmttttttgtcaaatctgcacgaggtgtgattatktcaaaacctatttggtatttttaatgaatattagtttttaaaaagttgttaataagtcaggtataccctttagaatctatagtttacggtttgtgtatggaaaatataatgctgtgttaggaaagaggattttgtaaaagtcgcacgaagtttgatgtctgtaaatctctttttacatgcyttttaaatttttttaatcgatattcattttawaaaatcataaccgtccattctatatttcgtgtaattcgtgtggatttacytttcataacagatagcatcattctgtttgtattttgtgcaaataattttcgtactaagtagcaacgttgatraataaaacga

SEQ ID NO: 270 - DNA, 401 bp, Artificial Sequence
  Consensus Reference Sequence
cgtccattctatatttcgtgtaattcgtgtggatttacytttcataacagatagcatcattctgtttgtattttgtgcaaataattttcgtactaagtagcaacgttgatraataaaacgaaaaagagattatgatgatgatgatgatgattggtacaaattgtattgcatgaatcacaaattaattccrycactaaactacatattttcgccaggtatgattttgtcaaaacccatttgtaattattattattattattattattattattattaacgaaaaayatgtgttgtcacgcwttatatttatatttctattttgcaaacacatttttattatattaaatttaaaattatatattataacaacattttttatttatgctcttactaaayyttta

SEQ ID NO: 271 - DNA, 401 bp, Artificial Sequence
  Consensus Reference Sequence
  misc_feature 379: n = A,T,C or G
attcaaaccgaactaattggtttggttccgataagcaaaacaatatagctttaaatagggtttgtctaactaaayctaagtaaaaatttcactgaaaaattcaaacttgcttcttatgatwtttaatgaaattcaaataacattctagaaaatatgtagcggtaaacatggcaggagataggtaagtacaggaatatgttaggycgttcacagcaggaacttgagccactgatacaactattgaggaagagcaaagaggttgtttacaagtgttcaaaaatagggaaatacaattttgtggctaagaattcttaccgtggaaaactaaaattaaagatcttgcagactcaattgrgaggtttttcaatattgaaatgcnagctcttattgcacgcgatcaa

SEQ ID NO: 272 - DNA, 401 bp, Artificial Sequence
  Consensus Reference Sequence
  misc_feature 92, 317, 321, 322: n = A,T,C or G
ccgattcggtgatcgcgccattagctatagctgctgctgttacwgttgctatagtwattaaatttattaaatktcttctgttmtaatttttncwtgattaattagggatatttggatagtctggataaggttttagtttcaaactttattgtctttattgtrtatwagcmaccgatttgtcacgcctrttatrtttttgcatttttattgtactttcgcatttctattaagctaattaaagatgttatatatatagttaaaaaattctcttattttatgtatrtatatatatatatatatatatatatatatatatntatnnatatatatatatattrgtttcatatgtttttaaatgcatgtttatctttagaattttctttacttcttatastctacta

SEQ ID NO: 273 - DNA, 401 bp, Artificial Sequence
  Consensus Reference Sequence
  misc_feature 84, 88, 89, 323, 324, 325, 326, 327, 328, 329, 330, 331,332, 333, 334, 335, 336, 337, 338, 339, 340, 341, 342, 343,344, 345, 346, 347, 348, 349, 350, 351, 352, 353, 354, 355,356, 357, 358, 359, 360, 361, 362, 363, 364, 365, 366: n = A,T,C or G
  misc_feature 367, 368, 369, 370, 371, 372, 373, 374, 375, 376, 377, 378,379, 380, 381, 382, 383, 384, 385, 386, 387, 388, 389, 390,391, 392, 393, 394, 395, 396, 397, 398, 399, 400, 401: n = A,T,C or G
aattaaagatgttatatatatagttaaaaaattctcttattttatgtatrtatatatatatatatatatatatatatatatatntatnnatatatatatatattrgtttcatatgtttttaaatgcatgtttatctttagaattttctttacttcttatastctactatttatgataatatatagtaattcaattttattctgtatattgtatgtaggctaccgtagttttttttccaacaaaatgatttgtattaaatggtaccaaaatacctaagatcsaaaaacatatacaccagtgacagtagaaagaaasmaaattcnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 274 - DNA, 401 bp, Artificial Sequence
  Consensus Reference Sequence
gtaaaatgattttacaytattataaattmttgtttgaattactttaaaataattattttaaaagtcaacaaacttatcacatagtgagttgcaattaggtaatggtttaaatatatttttrgtctmtgataaatactcattttttrcatttgrtccctaataaatttttgctttgtgatrggtccctaatatttaaaaagctttgtycgaagttcctrccgttagtcgaaatccattatcttcatatgtgatcgwtaaccgatcacgtaagattttttatwtttttatagaaaaaagtaaaaaaacgacatcattaagtccccgaatcctccaaaccacccccaccagtccycaaccaactcctccactagctccacaccaccgctattrtgtctccaaaa

SEQ ID NO: 275 - DNA, 401 bp, Artificial Sequence
  Consensus Reference Sequence
agtaaaatacaaaaaaaaaaacaagatcatatctgcatttccagaagtatyttatggaatctagattaccyaggaagtkaaattaaaaacttgaaaraagaaacagagaaaaaagaaaatattttaagataagttgtaacccggaatcaaamtaaaagtttataaatarttcaagcacatatatatattttggtgtcttgatcttattgatgtattttgcagacattgatatacttttattaccctatagagctrgaacaagatcaactaattgaaggtttagtgacattgtcacaaagcaaagaaaatgcctgatttatgaatattcacyttgaatctacgtgagtcagaacaatttcgttcaccaaaatatgccattgcagttgaggtggtcggtcgta

SEQ ID NO: 276 - DNA, 401 bp, Artificial Sequence
  Consensus Reference Sequence
ctgagktagcagtttgtcagtwgtgaaaccctccttgtccaacaattccatatgaggaacactacctgacaacattgctgatttcaaaagccttgwattcttggatatctcttataaactcttttcctcatccttgccattgggaattggtaaattagggagcttgcagaatctctcgttggctgaaaataacttctcctaactctatttcagaratggcctccatcaartccctcaacttgacttgcatgggaatatgcttcaaggtgtacccaacagtagtatgttagaaattctgaggaactctatgcattctgcactctactttttcacgaaatgcctccatttcaaaccaaataaaatggtgatcaaatcttcaatwctctcattaaaccaaaaaa

SEQ ID NO: 277 - DNA, 401 bp, Artificial Sequence
  Consensus Reference Sequence
tgtcagtwgtgaaaccctccttgtccaacaattccatatgaggaacactacctgacaacattgctgatttcaaaagccttgwattcttggatatctcttataaactcttttcctcatccttgccattgggaattggtaaattagggagcttgcagaatctctcgttggctgaaaataacttctcctractctatttcagaaatggcctccatcaartccctcaacttgacttgcatgggaatatgcttcaaggtgtacccaacagtagtatgttagaaattctgaggaactctatgcattctgcactctactttttcacgaaatgcctccatttcaaaccaaataaaatggtgatcaaatcttcaatwctctcattaaaccaaaaaatatatgaacccaac

SEQ ID NO: 278 - DNA, 401 bp, Artificial Sequence
  Consensus Reference Sequence
atrtcattatggasgtcaatgttcctaccmtgrgtagttaacacaaatgcaaascaaaaattcaataataattatttttatttttaaattctataaaatyattttaagtaaatatataatagatatattaaaattawtatattagtccccsttgatccttgtgtatgaaatawattggrttgggaggggratagtcaaatcatgtgcactcagaattctygaggaagattagtcacttagtatttttattttaaaaaaaattaaattatttactaagaaatarcataaattaaattagttttattctctttrggataatgactaaaaataattcttcttatgggccaaccattataggaaaaaaaaaamctctttcgcgagtaattaaaacaattgcatat

SEQ ID NO: 279 - DNA, 401 bp, Artificial Sequence
  Consensus Reference Sequence
agaattttttatctttcagcttgtccatcaattcaagatgaagtagattcagatcattcaatttacaagsctttccmgtcaccgcctctattatagtttttgtgaccttgagaacatcaaattcttgagaaacacaaacccatgccttraaatcaaaatcaaatatctgtttcaaattctcatcrttgtacaccaattggaccaaagtagtttttccaaccccacccatgcccacaataggaaccacagacacatcrctaccgtcactgttatcctccracaacaacttgattatggcctcchtatctttctccctaccatatatatgagatccatcttccagagatgttgatggagctttccatgacaagttctccactgcactctctttcaaatcaaga

SEQ ID NO: 280 - DNA, 401 bp, Artificial Sequence
  Consensus Reference Sequence
ctcaagaacaaaagatgaycagagtagaaagacaaaggcaagggaattggttgctatgaactgggttggttcttggtaaggttaactgatgtgatgagatttggcttaaktcaactstcttcaccttcactcgttctgctgtgcaagacaaaagtatggtcttttttatttgtattattatggtggtgggtgrcttatcrcgttgggagtctctttcctgttcyccacatgtttctttcttgatatttctattttgaatttwgctyctctaaactaaagactcaagagatttaaagagtgacratatttctacggttaatttaaaaaratggattatatttctaaaatgctttaattaaagttagtgccagctttctcgytttccaaaycgtgtgkagcag

SEQ ID NO: 281 - DNA, 401 bp, Artificial Sequence
  Consensus Reference Sequence
hacatgtgttttggatatttttatttaaaaattaagttaatartaaaattgaaaatgawtttttttgttaaatccaaaagttatgtaaagatgctcaayttagaatttctttctaaagttaaaatttaaaatcaatttttcaatgtgaaagtaaatagtcaaatatttacttaarttcgtgttagtttatattttaacctaattttttataatcaaayacagatcattaaagaaagttrtcatakagatatgttattgtataaagatctaatactgaatcatgattttataaaaagttaaaataattgatartamtttatgttttttaatmaagtgrtaaaagatttaaatctttattaattcttacatatagaataaattttgttassaggaaaataaaa

SEQ ID NO: 282 - DNA, 401 bp, Artificial Sequence
  Consensus Reference Sequence
  misc_feature 107: n = A,T,C or G
aastaaaatatattyagtgagatcatctcaaacaacaatagtaaaatgagagataaagaaaatttaagtccarcaaatgaaaatattttactatatrtaaaaaatantttttctcctatmatatttaataaatataattttattttaaatcaacaggtatawatttttatcaatagttaaaatagatttaagtgaacttyctagaaaaacttttttatttgtttrttwaagtgttgaaratatttatcctctaacttattttttmtcatyacaattawtttttyctttttacyaccaaacaaaaccttacaggatttttttactccactacacttgctctctcctcatttyttycaaaatacacctgcctcaaaattgtttcctaaacaacactccttttt

SEQ ID NO: 283 - DNA, 401 bp, Artificial Sequence
  Consensus Reference Sequence
tattttcagataaaaaataattaaaatttttaatattattattttgttttttaaataatgagaatatttttgtttaawtatttattwatagtttgaaaataattaattaataatcttaaaataaatttaaaaaacaaagtgattraaaaaatagatkgattaaaaacmcaataaatatatgattatcacatcttaattatattatattaaraaattaaaatactcaaataacataaaatactaaaaattaaasagacaaacatcataaatgraamatrtaataaagcaaaaatarcagaatgractaacaataataattgaaacatgaaaataatgaaagcataaacaactaacacatgaatcattcycattatcaacctcatttgattattaatccttgg

SEQ ID NO: 284 - DNA, 401 bp, Artificial Sequence
  Consensus Reference Sequence
taaaaaataattaaaatttttaatattattattttgttttttaaataatgagaatatttttgtttaawtatttattwatagtttgaaaataattaattaataatcttaaaataaatttaaaaaacaaagtgattraaaaaatagatkgattaaaaacmcaataaatatatgattatcacatcttaattatrttatattaaaaaattaaaatactcaaataacataaaatactaaaaattaaasagacaaacatcataaatgraamatrtaataaagcaaaaatarcagaatgractaacaataataattgaaacatgaaaataatgaaagcataaacaactaacacatgaatcattcycattatcaacctcatttgattattaatccttggrawggaggca

SEQ ID NO: 285 - DNA, 401 bp, Artificial Sequence
  Consensus Reference Sequence
taataatgataataataataataataataataataataakaagaataaggygratacaagctagatcttacataatggtaattaggaaaaacaaaaccagaraccccctctrataggraagagtgatagcatagcatacaaagggatgcagaaaaaatagatgtgaatcaagacatagcaactayaggrgwgtctatagcaaagaagggtgcaaatcaagcagaaaaggaggtgcaascagyagttaataccaaaagaaagatmtcgaagcytgcttaccttaaggaytacgtgtgatcctaaggaatgatgytgaatgatctgtgctrgaagcaagggagacaagaataacgatttctgatttcctctagcacaaaaggacaaaatctgttatgtagaaa

SEQ ID NO: 286 - DNA, 401 bp, Artificial Sequence
  Consensus Reference Sequence
agaataaggygratacaagctagatcttacataatggtaattaggaaaaacaaaaccagaraccccctctrataggraagagtgatagcatagcatacaaagggatgcagaaaaaatagatgtgaatcaagacatagcaactayaggrgwgtctatagcwaagaagggtgcaaatcaagcagaaaaggaggtgcaascagcagttaataccaaaagaaagatmtcgaagcytgcttaccttaaggaytacgtgtgatcctaaggaatgatgytgaatgatctgtgctrgaagcaagggagacaagaataacgatttctgatttcctctagcacaaaaggacaaaatctgttatgtagaaatcartataaatacaawwgcatgtaataagcagcacrrtatg

SEQ ID NO: 287 - DNA, 401 bp, Artificial Sequence
  Consensus Reference Sequence
atcctaaggaatgatgytgaatgatctgtgctrgaagcaagggagacaagaataacgatttctgatttcctctagcacaaaaggacaaaatctgttatgtagaaatcartataaatacaawwgcatgtaataagcagcacrrtatgaatgaaattagcaaattactcccatctctgctcttcttcttcctctggaggttyaggtgcctcaaagccarctcttaatttcctgcatttatgtttagttygtaacaattggtgctctcgttygtcctcatggcctchygcaacctygaygaggyccttgttcrtcttgacaataccatgcactctatgaccctcaayatggacaagcttctcaaccrccttrctcttgtgccttcctccaycacgcccaacccc

SEQ ID NO: 288 - DNA, 401 bp, Artificial Sequence
  Consensus Reference Sequence
ayatggacaagcttctcaaccrccttrctcttgtgccttcctccaycacgcccaaccccacaccagtccctygccackccacctctgttcytgcacaaatycgrtatgccycatcacygtatgaggatcytgcyratgccttgttcaaactcactyagacgggttcagtgctaacatacctgaaggagttcgaagacttgactaatagaattatcggcttkycggcccccttcctrttgccttgcttcatctcgrgtttgacrttgaagatctgccgcacagtccargtccmccagcctatgactgtggaccaggccgccrgccttgygaagatccaggagcagaagctatcrgaccttcgtctgcctccaycgcggccgcgaccccaccrttggtagctc

SEQ ID NO: 289 - DNA, 401 bp, Artificial Sequence
  Consensus Reference Sequence
ccagtccctygccackccacctctgttcytgcacaaatycgrtatgccycatcacygtatgaggatcytgcyratgccttgttcaaactcactyagacgggttcagtgctaacatacctgaaggagttcgaagacttgrctaatagaattatcggcttkycggcccccttcctrttgccttgcttcatctcgrgtttgacattgaagatctgccgcacagtccargtccmccagcctatgactgtggaccaggccgccrgccttgygaagatccaggagcagaagctatcrgaccttcgtctgcctccaycgcggccgcgaccccaccrttggtagctccaccrccagyccctttggytccccctcgtatgacgcctttgccccctttgttgcctkccccg

SEQ ID NO: 290 - DNA, 401 bp, Artificial Sequence
  Consensus Reference Sequence
ccctttggytccccctcgtatgacgcctttgccccctttgttgcctkccccgccataggctccgaccgtcaggcgtchyaccccrraggagttagyctcgcrycatgagcackrgctrtgcttcacatkcgatgagaagttccatagaggccattgatgtgcctctagggttcatctcttaatcgcaraggatgaggaacctgtagactaggggtgggtaaatgggcccaagtccatggactggcccgcggcgcacgcggtccgcgcgagttacggtccaattttttaaaacagttcatggttatgtyatattttttggcccrccccgcttaatccacggactatgcgggtttggccgcggggtccacgggttgcycgyaacccgcattwggtttgatttg

SEQ ID NO: 291 - DNA, 401 bp, Artificial Sequence
  Consensus Reference Sequence
actggcccgcggcgcacgcggtccgcgcgagttacggtccaattttttaaaacagttcatggttatgtyatattttttggcccrccccgcttaatccacggactatgcgggtttggccgcggggtccacgggttgcycgyaacccgcattwggtttgatttgtgtgaccctgacccaattatattaggtttrattttctccttttcwctttaaacttttcttttaaaataacagataaagaaatatattatataagataaagatttaaagrtaaaaataaaagatttaaattaaaasatggtaaagataaaaaagataagataagaaaaataaaagataacagaaataaaakattaagataaaaaaakataagtgataacatgytaaaaatcttcttttct

SEQ ID NO: 292 - DNA, 401 bp, Artificial Sequence
  Consensus Reference Sequence
tgccaccacgcaaagtacatctcttctctctytagaatttgtttttatcctatttttgttgggaytgattcatttttgttgtactcttaaatgtggagatggagaakgytcaagctacttcaaatatgraatcatttgttgtcagagatgtttaaatttcatattttagatttattdyttggattttctttygttaagacattatttattttattgatgtaattgactaattattgagattttatttacakctatattgaacttaatttgattgtattgtatttttattaaaattgaaattattttaaaaytaggcccgtggatcggcccgtttgactcgtgggrtccatgggcrgrggcggaccaatttatttggtccrtgtaagaagcrgggcgaactg

SEQ ID NO: 293 - DNA, 401 bp, Artificial Sequence
  Consensus Reference Sequence
caagctacttcaaatatgraatcatttgttgtcagagatgtttaaatttcatattttagatttattdyttggattttctttygttaagacmttatttattttattgatgtaattgactaattattgagattttatttacakctatattgaacttaatttgattgtattgtatttttattaaaattgaaattattttaaaactaggcccgtggatcggcccgtttgactcgtgggrtccatgggcrgrggcggaccaatttatttggtccrtgtaagaagcrgggcgaactggcccgctccgcttcyaatgcgggcgggccttacacggggyggggtggcccgcctacccacccctaycgcatacccattgggtcctaatatagagmaacctracccgaakc

SEQ ID NO: 294 - DNA, 401 bp, Artificial Sequence
  Consensus Reference Sequence
attttaaaaytaggcccgtggatcggcccgtttgactcgtgggrtccatgggcrgrggcggaccaatttatttggtccrtgtaagaagcrgggcgaactggcccgctccgcttcyaatgcgggcgggccttacacggggyggggtggcccgcctacccacccctaycgcatacccattgggtcctaatatagagmaacctaacccgaakctagccacacccgtatcygaaggacctgacccaaarcccacacytgactcrgaccyaaaccccacacccgacccggaacygrcccaaattagttcraactccttatcgggtgatttagcaccgagaattttgcaccycgtcggccttctctccgrcaatcgtgtggtcctccttgttgatgrgggaagtaac

SEQ ID NO: 295 - DNA, 401 bp, Artificial Sequence
  Consensus Reference Sequence
ggcccgcctacccacccctaycgcatacccattgggtcctaatatagagmaacctracccgaakctagccacacccgtatcygaaggacctgacccaaarcccacacytgactcrgaccyaaaccccacacccgacccggaacygrcccaaattagttcraactccttatcgggtgatttagcaccgagaattttgcaccccgtcggccttctctccgrcaatcgtgtggtcctccttgttgatgrgggaagtaaccacaacttcctccagcctcaactagytatctctctgggcttaccttgycggaccgctccaacaccattacgcgtgatgttctttcatcacgggcgcttmgtggaatttctgggtgagaacgccaccactccgggtcttcttcccc

SEQ ID NO: 296 - DNA, 401 bp, Artificial Sequence
  Consensus Reference Sequence
tccgrcaatcgtgtggtcctccttgttgatgrgggaagtaaccacaacttcctccagcctcaactagytatctctctgggcttaccttgycggaccgctccaacaccattacgcgtgatgttctttcatcacgggcgcttmgtggaatttctgggtgagaacgccaccactccgggtcttcttccccaacaccagttctgccacctctrtcgrcacaacgagggtktttcgcacttccatattgctaggtttcckraagctcctcctgactcactacccattgacacacctagtgcagttcgtcrgaataaaccttgggatcccggtattgtttttggaygccatagtttgaaaaaccaacaccatgaggacatgtttttgatggggcagggagtgataag

SEQ ID NO: 297 - DNA, 401 bp, Artificial Sequence
  Consensus Reference Sequence
rcacaacgagggtktttcgcacttccatattgctaggtttcckraagctcctcctgactcactacccattgacacacctagtgcagttcgtcrgaataaaccttgggatcccggtattgtttttggaygccatagtttgaaaaaccaacaccatgaggacatgtttttgatggggcagggagtgataaggaagcgtgataacatagyagacaaagggatgtattcaaaagaaatmgatrygaatcaagacatagcaactataggggtgtctacagcaaagaagggtgtaaatyaagyagaaaaggaggtgcaagcagcagtcaataccaaaagaaagatctcaaagcctgcttaccttaaggactacgtgtgatcctaagsaaygatrttgaatgatctkt

SEQ ID NO: 298 - DNA, 401 bp, Artificial Sequence
  Consensus Reference Sequence
  misc_feature 151: n = A,T,C or G
ctctgtggaggccctggtcctcvaaaamcagcttctatcwtcttccctatcaacaagtatatarcatatataattatgyatgayaattttaaraaaataaacaacactaatataaaatatatagaatggtaaaatamaaaaaaaaaaaaanaagatcatatctgcatttccagaggtatcttatggaatctagattacccaagaacagaaattgaaaacttgaaaaaagaaacagagaaaaaakaaaatatttaagatatgttgtaacccrgaatcaaaataaaagtttataaataattcaagcacatatatatayaccaaataataatascttagtaaaagcaaawaaataataataccttagcaaawtttcctctgaaaasagagagtggaaccttcca

SEQ ID NO: 299 - DNA, 401 bp, Artificial Sequence
  Consensus Reference Sequence
aaataatttttatttttattttaaataaaaaattattatgaaatataagtttttatcaatwgttgagataaatttawgtgaacttggtatcaatsattattgtgtagttaaagtccyagatccaackactcataaaartttaaatttyctttgcatataatataaatagacataactctaaaaatgaatttttattttatgtttttgttaaagtcttaaaaatatttatcctctaatttattttttctcctcacaattatttktatcttttgtaaaagataaattataatgtttttttaaacaattttaatmtactattattatatttttatttaatatttaagaatatttctataatttaaactcatgcactaartataaattatattttttcatgayat

SEQ ID NO: 300 - DNA, 401 bp, Artificial Sequence
  Consensus Reference Sequence
gcactaartataaattatattttttcatgayattaatgyaaagtatttatcaattttryatactgataactcatctttgwagagaaatttagttagtaatctttaaygaagtyactatttttaattatttttaatatgtaagacttaaatmtaaaatyttgagttaaggagatgtattttatttttgtcttaactcttcgattcatcatrkraaatgatcctgaaatcagagttaagtaaaatcttatcaataattatttttgttaarycgaattcarataatatccaaacgattcaaytttattttaaataractaataacttatactcagtcacttartcatttggttgcatcagatttaatttcactctaggcaataacatgttggtcacaakaatat

SEQ ID NO: 301 - DNA, 401 bp, Artificial Sequence
  Consensus Reference Sequence
yactatttttaattatttttaatatgtaagacttaaatmtaaaatyttgagttaaggagatgtattttatttttgtcttaactcttcgrttcatcatrkraaatgatcctgaaatcagagttaagtaaaatcttatcaataattatttttgttaarycgaattcarataatatccaaacgattcaaytttattttaaataaactaataacttatactcagtcacttartcatttggttgcatcagatttaatttcactctaggcaataacatgttggtcacaakaatatatattacatattaactttraaaataaaatataataaamtttctaactcaactttttaawtttcttarttttcattctaatartatggtcactcatcaaagcatggcttgggt

SEQ ID NO: 302 - DNA, 401 bp, Artificial Sequence
  Consensus Reference Sequence
cctgaaatcagagttaagtaaaatcttatcaataattatttttgttaarycgaattcarataatatccaaacgattcaaytttattttaaataractaataacttatactcagtcacttartcatttggttgcatcagatttaatttcactctaggcaataacatgttggtcacaakaatatatattacatattaactttaaaaataaaatataataaamtttctaactcaactttttaawtttcttarttttcattctaatartatggtcactcatcaaagcatggcttgggtatatactatatarmgaagatcctccgtcatcttgaggatatwtcatgatcataagtggaataagaatgcacatattgcaaagatagaaatttawkaaagacagtgca

SEQ ID NO: 303 - DNA, 401 bp, Artificial Sequence
  Consensus Reference Sequence
atatattaaaagcggytttttcamcaaataaakatttgctaarmaaatcatcacsraaataatattgaaaaaaatacaaataagttcgtttggstttrctttttyatacatgckgttagaataaaggtgtaatcactactagaaatgagytatttaatgatgcacatctatcagggattgttttagaatgtgtctgygtggtaattttgtaattagaggaaaaaacaacgataattttctgtgataattgttgttttaattcctcttagtagtgaccttgagaatayttataarcyggaagtggtagggaaaaatacttgttgtaatcaagtttgattagtgaaatcctttactggttagtaaaggagaactaaggagaactaracgtaactcargtgayc

SEQ ID NO: 304 - DNA, 401 bp, Artificial Sequence
  Consensus Reference Sequence
cttagacwatccttagtattagtttctctttatctgtcttgaatttgtgattagttgcyatatttctttatcttatcatgacttgttttcttaattcggattatgattagcatataagggttagtactatrggttttatgaatatatcaaatcaaatatacaaatgtttaaatacatctaagttaatatcaacccagtgtgtcattctcttttatctcttttcctccctcawtatctwaaagtatrtaatttcaacaataacaagakattttttggtgaacacaacaaaatgctaaaagttgtaatcatcatattcatgatctgaaaataacaaagatgaactcattttyagatgtttgatgccaaaagaaaaaggatgagttacccagctaatattaact

SEQ ID NO: 305 - DNA, 401 bp, Artificial Sequence
  Consensus Reference Sequence
aattatttttgttttaaaaaatttacttattttaacaaataaattccatttgtttcttaaaaaaatatttatttttaaattattttaaaaaattwaaacaaactcaccttttatttgaattgtttgtgcttttaaaaawawtttttttttcttgttttaagaaataaattctatctatttttttttaaaatatttatatcagcgatacgaatatstaaataaagagactaaatattgttgtcttggagtggtatgttttcaatttctctctatatatagttataattattttattatattaataaatgtgacgtatggatgaaacactctgattactatactwtttctgcacacatttttattttgctttaatcttagaaaktacacattgataaaagaaa

SEQ ID NO: 306 - DNA, 401 bp, Artificial Sequence
  Consensus Reference Sequence
taaaaaatttacttattttaacaaataaattccatttgtttcttaaaaaaatatttatttttaaattattttaaaaaattwaaacaaactcaccttttatttgaattgtttgtgcttttaaaaawawtttttttttcttgttttaagaaataaattctatctatttttttttaaaatatttatatcmgcgatacgaatatctaaataaagagactaaatattgttgtcttggagtggtatgttttcaatttctctctatatatagttataattattttattatattaataaatgtgacgtatggatgaaacactctgattactatactwtttctgcacacatttttattttgctttaatcttagaaaktacacattgataaaagaaaatcttcaactacta

SEQ ID NO: 307 - DNA, 401 bp, Artificial Sequence
  Consensus Reference Sequence
  misc_feature 167: n = A,T,C or G
actctgaagggaagcgtgtggcagtcaagtattactcagatgactggccaacaaacaatgcaaagttagcttktgasaagtttgtatttaccaagactgttaagacaaatgctcgtagaaggtaagcagtagagtttgacaactatgaatctatgaagtcactatanttaatattaggtgctaggggtggctgtttcaatctaaccatcatkttttatgtaacagatttttgcttaatgattacgctaggggtggccggagtacgtgatgagaaakgtatcctatcattaaggattgttacarmagtcctcttatatgcgtgtgtgggtaaatgggtattgaaaatctcacacttgatataattttttcatgtrccaatacagagacaaagaagytycaaa

SEQ ID NO: 308 - DNA, 401 bp, Artificial Sequence
  Consensus Reference Sequence
agtaagaaatcatttttggacataaacgtcagtaaaaawtttatggatcaaattgtcagtatttttttgttgaaggaatttgycagtaatttcacawagttgcagtaagctttgcacaattcttggggtgtccaracattaaccaaatctttttcaacttcttcccagacatagaattcaccatcgacatactccagtgccccrtttgcattttgtatgaatttagcattgtggtgtaaaataagaytgatttcatcagacatcctatayagagaaatataacaaaaattaattgtatattcacaaaaagagaacataaaaagtttcataatagagaacaraaggcaagtttcataatagagaagagaagagaagaartttgagaataaagaagagaacac

SEQ ID NO: 309 - DNA, 401 bp, Artificial Sequence
  Consensus Reference Sequence
atgaagaacttctcttgtagaagtttctgaaagtgtgggagatgaagaaaaatyaaraacctrgcttttgggaatgaagagtcaattttggattgtgtaatccttttgggaatgaagaaaattagcagatgccaaaaaaccctatatatttattttcacaatracgggaaccatagaatgcaaggcttgtattattcactatcctatatatttatttaccaaacwttggtggaaattttaaggagtgacaggttcatattagcttttaaccatcaatggaaaactggaawaaagaaaaggctggcactaacaaccagttatttgtcaataggaaaggaagcttggcccaattgaaggatrttgtggaaaattagtgtctctttgatttcagaagctttacc

SEQ ID NO: 310 - DNA, 401 bp, Artificial Sequence
  Consensus Reference Sequence
taccgatcttcctatyrgaaaagcgagaaaaaaagtttcttaccttgttttggktggcagctttggtgaaaacatggtcgagtaagtcatcrgcttcatagacagcatctttgagatcattgagccagtgtttgacattggtgtttgyggtctgtttcttctcggcatcatcaagcacagctccaaccactctgagagtgatctccaacttttgaagcaacttcttgctaagcttctttccaaggatcaagtsaacaaactcaggtgaagccagcctgtcgaaaagcacatcaaggaaagcagagagaaaggcaccacctaccactgctgctgccattacctcaagaataaaagatgatcagagtaraaagacaaaggcaaggaattggttgctatgaact

SEQ ID NO: 311 - DNA, 401 bp, Artificial Sequence
  Consensus Reference Sequence
cttcactttcastcgttcttgataaggtttttttatttattatttgtattattatggtggtgggtgacttatgactagtttcatttctgtttccaaaccgtgtggakcagtggtgtatgtttttttctttcatttctgaaattgcttgyaggtttcacaaaacactgatcccttttctttgtgatatgtatggatggctgcaagggtactytgcgtatttaagttcctgttaatggtctgtaagacaagttgtattaaggcagattgtacatgtgtttgtatgaacggtacaaaagttgatttyacaaatctaatttatatttggatatttttattccaaaaataagttagtagtaaaattgaaaatawttwttttttgtgtaatccaaaagttatctaaa

SEQ ID NO: 312 - DNA, 401 bp, Artificial Sequence
  Consensus Reference Sequence
ttaacataattttagaaaatcaaacataaatmtaatatgcacgattaaagttgtcatagagatgtgttgytctrgaaargtttaataacaaaccatgatctcataaataattgacattagtagtagtaatttrtgtttcttaatcaagtggtacaagattcaaatcatgattaatctttacatawagaataaataaatataaaattaaaaaatattaaaccaaaaaaaaagaagtattgaacaaataaaaagaaagaattgaacaaaagrcacatgctaatkgatccctaagaacataatattaatgaattaaagagttcaatatgtccttatytgtacatarmaaakaaaagaagtatgtagaaagaaaagtgtgtgattttttactaaataaaatcaat

SEQ ID NO: 313 - DNA, 401 bp, Artificial Sequence
  Consensus Reference Sequence
ataatttctataaamtatatttttattttaaatcaacarctattttgaagtataagtttttatccatagttgaaatggatttaagtgaactttatattaatgactattatgccgttaaaaaaagggtaaccagtcattttcgtcatgcaatatgtagaacactgacaaattcgttacagaaagatgtaaattctaattttagtcctcgaaagtgaaaaaagtgtgayaaattcattcatctattaacttccattcgttacttttaatgaaagagcaaacatgacacattcagggaygaatttgtcaaygctcaacacatccagggrcaaaaatgattattcayccaaaatataatttaatcttcatctttctcatttttcaatcgttgcaagcayagttgt

SEQ ID NO: 314 - DNA, 401 bp, Artificial Sequence
  Consensus Reference Sequence
tatgccgttaaaaaaagggtaaccagtcattttcgtcatgcaatatgtagaacactgacaaattcgttacagaaagatgtaaattctaattttrgtcctcgaaagtgaaaaaagtgtgayaaattcattcatctattaacttccattcgttacttttaatgaaagagcaaacatgacacattcagggaygaatttgtcaacgctcaacacatccagggrcaaaaatgattattcayccaaaatataatttaatcttcatctttctcatttttcaatcgttgcaagcayagttgtgaaatsyagtttggctcagctattcggaccaatccaactgagacccggtggtytagccgaaccarttccactattggatcgrtcatacaattgacactggaggaccc

SEQ ID NO: 315 - DNA, 401 bp, Artificial Sequence
  Consensus Reference Sequence
gtaaccagtcattttcgtcatgcaatatgtagaacactgacaaattcgttacagaaagatgtaaattctaattttrgtcctcgaaagtgaaaaaagtgtgayaaattcattcatctattaacttccattcgttacttttaatgaaagagcaaacatgacacattcagggaygaatttgtcaaygctcaacacatccagggacaaaaatgattattcayccaaaatataatttaatcttcatctttctcatttttcaatcgttgcaagcayagttgtgaaatsyagtttggctcagctattcggaccaatccaactgagacccggtggtytagccgaaccarttccactattggatcgrtcatacaattgacactggaggacccagccaaactaggacaatt

SEQ ID NO: 316 - DNA, 401 bp, Artificial Sequence
  Consensus Reference Sequence
caactgagacccggtggtytagccgaaccarttccactattggatcgrtcatacaattgacactggaggacccagccaaactaggacaattagccaccakatcccggttggaccagtcygacctgactgattttacaaaaaaawaawaaatcacctctacrgtgttgttttgatgtcttattattatcaattgttatattagattatgaagtatggatggattttttttgctcaaataatgttagttatatayttatatatagataaatatataattttaaatttttataatatatcaggtcaaacaagtycaatgactggtccaacaccactrrcccacccaccaaatattttgatttggtcaatgatcgaactgagtttcacaactatagttgcaagta

SEQ ID NO: 317 - DNA, 401 bp, Artificial Sequence
  Consensus Reference Sequence
tacaaaaaaawaawaaatcacctctacrgtgttgttttgatgtcttattattatcaattgttatattrgattatgaagtatggatggattttttttgctcaaataatgttagttatatayttatatatagataaatatataattttaaatttttataatatatcaggtcaaacaagtycaatgactggtccaacaccactarcccacccaccaaatattttgatttggtcaatgatcgaactgagtttcacaactatagttgcaagtataacattacaataaacacttaaaaaatagraaaacaaaacttagttaaaacaaacataatgataaacataatattgatttaaaagcttattattatgtttattctaarttatgttwgattttctatttttttt

SEQ ID NO: 318 - DNA, 401 bp, Artificial Sequence
  Consensus Reference Sequence
gtaactgacatgtatcttatcattcgtgcagytatcatckgtatatwgagcacaacacgggaaggygttgactggctggtactaygaatattcatccgccacgtgrcaccatatgattggatgaccttgctactagtcatrggaagagcccgccttgtggttaggtgttgaasgatgtttggcatagcatcattttcattgtccctrattctcaccaatctcacacccaaaagattttgtcactttataacaagagagttgttactaasatttaataamggaccaaaaagtttgaatgataaactatacagtatttttaacaattttaatatactattattatatttttatttaayatttaaaaatattwctataatttaaacccatgcattaartataaa

SEQ ID NO: 319 - DNA, 401 bp, Artificial Sequence
  Consensus Reference Sequence
tgtggttaggtgttgaasgatgtttggcatagcatcattttcattktccctrattctcaccaatctcacacccaaaagattttgtcactttataacaagagagttgttactaasatttaataamggaccaaaaagtttgaatgataaactatacagtatttttaacaattttaatatactattattatatttttatttaacatttaaaaatattwctataatttaaacccatgcattaartataaagtaattttatattattattcactcatatatcatcattaatataattttwaagataattattatagttattatagatgataaaataatattgaatgaagttttaaatttgatttacacttttattatatgacytattttttctatttattaacaag

SEQ ID NO: 320 - DNA, 401 bp, Artificial Sequence
  Consensus Reference Sequence
acaattttaatattctaatattatatttttatttaatatttttaagttttaagttttcttagtatttaagaatatttattaacaagaccttttatggctatttttttyagtaatgagaattttgcattttatttcactcactataataataatgatgaygattgagttatgttcaagtgaagcgagtgtatgcatgagtgcaaattaacttatttagttgaycagacttttcttataattcacaaaggttrttacaaaaattcaatgtatmtaatttaagtataytaatgcattaaaatctatttatatatgtatatataagatatatttrttaaattcttaattgaaattgtaagaaagatgaagaaaaaaatcaaccarbaggcaaaaatcaaatcaaa

SEQ ID NO: 321 - DNA, 401 bp, Artificial Sequence
  Consensus Reference Sequence
tatatttttatttaatatttttaagttttaagttttcttagtatttaagaatatttattaacaagaccttttatggctatttttttyagtaatgagaattttgcattttatttcactcactataataataatgatgaygattgagttatgttcaagtgaagcgagtgtatgcatgagtgyaaattaacttatttagttgaccagacttttcttataattcacaaaggttrttacaaaaattcaatgtatmtaatttaagtataytaatgcattaaaatctatttatatatgtatatataagatatatttrttaaattcttaattgaaattgtaagaaagatgaagaaaaaaatcaaccarbaggcaaaaatcaaatcaaattcagattctatcattcatga

SEQ ID NO: 322 - DNA, 401 bp, Artificial Sequence
  Consensus Reference Sequence
tcatattattgagacctcacktgattttatttgtgtgaaagattttgatagawttttacttattcaatactactataaaatggatagtacaaaatttcgaaacaatatagartatacygatattcctttttatgactttacatttcttaatttctaatgytatacaaagtttttatactacaaaaartagatcatcaaatatatttttattgaaattaagaattttttttattatgaaaatctccctaattaaatgtaacaaattaaatattttactctattatttttataaatactagtcaatgcttaaagaacatttaataaaaaaawtattattttgaatacataaagataaagaatataccatactataatatttggtctttaaaatgattaaacac

SEQ ID NO: 323 - DNA, 401 bp, Artificial Sequence
  Consensus Reference Sequence
aattttcmtcaatatttttctgagttattattatttttatcttcattcttatttgaaaattttgaaatctggattcatttttgccttcaaggtttttaaacttttcgattttattattgtgggttttaaagtgattttttctttctaaattgtctctttktctctttgtttgtttcatgagaaacatcygtcatcatggtataggggatttaaatttkatgcttctgagttatttgtagtctattagcgtgtttgatttcacatcatcgacgtgatcattmtctgggaatgtgatttcatgaagctactagttatakcttctacatatctcagacatgattttttatttctcaaactgatttcyaacacgctatatatttcatgtgaaagaaaagacacat

SEQ ID NO: 324 - DNA, 401 bp, Artificial Sequence
  Consensus Reference Sequence
tgacaataacttagtgcatgtgacccaagcatgaaaattggtagatagactgccaaagttaggtaacsattgtaayggaaagtggaaccacatgcatctgaaaaaaggtgccaactcagttatatttttacttgcctatttgaaacyttactgaattttcgttttcttctcgagtgtcattaaactctcccaactttagaagattaatttgggcagatgagtgtgaatgacttgatttgtctatgtaattcaaaacagaatgcaggtctcacttgtttgcatgttccttttttatgaatctcaagttcattattgatgtattttgttgtattagtgtgctttctgccatctgctgattgattgtttgattaaattttatttcttctgmgtaatgtgttgcc

SEQ ID NO: 325 - DNA, 401 bp, Artificial Sequence
  Consensus Reference Sequence
tatcttttgyactaccaaacaaaaccttacaagagtacttgcttagtaggggtggkaataggytaagccggyctacaggggyctatgacctgrcctacataaagtctagcctatttaattaaaaggttagactaagacttttttaaaagcctattagattaaacakatcagacttaggcttattaaaaaaccttataagcctgatagrccggcctatatatatatatattattattttttgggtaccaatatataatattattttttggatayaattaatyttttttttgaaactatcagactttgattacactccataacttttattcytataatcaagaactttaattacaatttaggtrtgagtacggtgtccttttatattyctcattattttgatt

SEQ ID NO: 326 - DNA, 401 bp, Artificial Sequence
  Consensus Reference Sequence
ttttgggtaccaatatataatattattttttggatayaattaatyttttttttgaaactatcagactttgattacactccataacttttattcytataatcaagaactttaattacaatttaggtrtgagtacggtgtccttttatattyctcattattttgattgactttcctttttctttaactttcctattatgttcctactccataaaatattaaatatttattgtgaagaaggcttttaaaaaggctatcaggccasaccaggcttttaaaaaggtcaggcygagctaaaataaaagyttttgataggctataggtyagactyagacctcaaagattcatcgtagactaggctcaggccttttaaagycttgcctgacctatttccacccctattg

SEQ ID NO: 327 - DNA, 401 bp, Artificial Sequence
  Consensus Reference Sequence
tttattcytataatcaagaactttaattacaatttaggtrtgagtacggtgtccttttatattyctcattattttgattgactttcctttttctttaactttcctattatgttcytactccataaaatattaaatatttattgtgaagaaggcttttaaaaaggctatcaggccasaccaggcttttaaaaaggtcaggccgagctaaaataaaagyttttgataggctataggtyagactyagacctcaaagattcatcgtagactaggctcaggccttttaaagycttgcctgacctatttccacccctattgcttagtagaatccarctaagtatcatctcttctcctaaatatttgttakagtcttgttaataaaacaaatctttttttaatttttt

SEQ ID NO: 328 - DNA, 401 bp, Artificial Sequence
  Consensus Reference Sequence
tagaatccarctaagtatcatctcttctcctaaatatttgttakagtcttgttaataaaacaaatctttttttaattttttaatcaatactcttaaaacaaagatcaaacacactttctaaaagtattccattttatttattttatgaataagtagtattaaagtgtatttcactaaaaraaataaaaaaatgaaatacaatacattttttaataagatgaagtaaaagaagtgaaatatatatatatatatatatatatatatatatatatatataattttcataaatgtagtaataaaataaatgaaaaaaaaggtaaatagtcattttctttgaagygattgtatgcatgagtgtaaattagcttatttagttgaccagactttccttataattcaca

SEQ ID NO: 329 - DNA, 401 bp, Artificial Sequence
  Consensus Reference Sequence
aaagtcaraagtcatttgaaatgtaacakaacatttctttacvaatctaactagattttaaacttgtgcaktgtaccaataatgattgacacaartagtaatgacttgtatttyttaactaaatggtctagaktttgaatattggttaacccatacgcatagarttaaagaaagaayacatgytaatttattcctaaaaacataatattaatgaattaaagatttcaatgtccttacatatatgtcaaagatgtatgcgraaagaaaagtgrgtgatttttactaaataaaaycaataaaataaataaataatagatactaatatattatattaarttttgacaggtagatatycccataattttatatttatawtaaaaaaaaataggcttccadgtats

SEQ ID NO: 330 - DNA, 401 bp, Artificial Sequence
  Consensus Reference Sequence
tacgcatagarttaaagaaagaayacatgytaatttattcctaaaaayataatattaatgaattaaagatttcaatgtccttacatatatgtcaaagatgtatgcgraaagaaaagtgrgtgatttttactaaataaaaycaataaaataaataaataatagatactaatatattatattaarttttgacaggtagatatccccataattttatatttatawtaaaaaaaaataggcttccadgtatsaaaaatagractcagagagaaggggagtggcggatacaagccagatsttgagaatggtaattaggaaaaaacaaacccagacccmctccctttcytaargaagarcttattctcagcctctacgtacactctccttacaakctatccattcca

SEQ ID NO: 331 - DNA, 401 bp, Artificial Sequence
  Consensus Reference Sequence
acttasctcaaggattgcaagcaggtgcaccatatctcgaagcaatggcrgacctacagccatctgaggrygtgcacttgyaymccctcattttttaaaattcaccaaatttgtaaataaaatcttatatttttatagtttatttcatctawatttatataattgaacycattrattttattttttataatttgtaccaactracttagggtggatccgccactgtactggaagaatgatgytggtcgtgtaggggtagacaaacttaaccatttcctgatattctvtagcacaaaaagacaaatttgaytattgagaaatcagtataaataatactatgtaataacaacatyaatcaatggaatatacaattrttccttcccttattcttttctcactgg

SEQ ID NO: 332 - DNA, 401 bp, Artificial Sequence
  Consensus Reference Sequence
  misc_feature 342, 343: n = A,T,C or G
rattttattttttataatttgtaccaaytracttagggtggatccgccactgtactggaagaatgatgytggtcgtgtaggggtagacaaacttaaccatttcctgatattctvtagcacaaaaagacaaatttgaytattgagaaatcagtataaataatactatgtaataacaacatyaatcaatggaatatacaattattccttcccttattcttttctcactggaggccctgrtcctcgaaaaccaacttttatcttyttccctawcaacaagtatatagcatatataattatgtatgataattttaagaaaagaatggtaaaatacaaaaaaaaaannaaaaaaaaaadatcatagctgcacttcvagaagtatcttatggaatctagattaccra

SEQ ID NO: 333 - DNA, 401 bp, Artificial Sequence
  Consensus Reference Sequence
  misc_feature 58, 59: n = A,T,C or G
catatataattatgtatgataattttaagaaaagaatggtaaaatacaaaaaaaaaannaaaaaaaaaadatcatagctgcacttcvagaagtatcttatggaatctagattaccraggargagaaattaaaaacttgaaagaagaattaaaatgatattaaaatcctcattattctattaaaaayaacaataaaataaaaaaattctaatcattcttagttaaatttgactatcaattaaacycaattttcatagttatcaagtagtagaagtttttgttgsgaaagygttaagagtgdtagtgacattaaatatcgttgcaaaacttttcrcaacagatgatattacagtggactgcagcaacaattttctygctwgmaaaagtaagggattaayraat

SEQ ID NO: 334 - DNA, 401 bp, Artificial Sequence
  Consensus Reference Sequence
  misc_feature 15, 16: n = A,T,C or G
atacaaaaaaaaaannaaaaaaaaaadatcatagctgcacttcvagaagtatcttatggaatctagattaccraggargagaaattaaaaacttgaaagaagaattaaaatgatattaaaatcctcattattctattaaaaayaacaataaaataaaraaattctaatcattcttagttaaatttgactatcaattaaacccaattttcatagttatcaagtagtagaagtttttgttgsgaaagygttaagagtgdtagtgacattaaatatcgttgcaaaacttttcrcaacagatgatattacagtggactgcagcaacaattttctygctwgmaaaagtaagggattaayraattgtttatggtacracagttagtcatcatgaagggayaactatc

SEQ ID NO: 335 - DNA, 401 bp, Artificial Sequence
  Consensus Reference Sequence
  misc_feature 84, 121, 335: n = A,T,C or G
gttttaaawtgtagtcagcaacctaattgcagtcataacgctaatgtattttgactctgtaatcacatcacaattataattatnatcacatcarttgtatttttccataattatccacaantcacaatgtaagatttttaggttcgttgcatgcaacgcaatcakaattgcaatttaaaatcatgtctaaagccatgcaaaattgatgcggcatcactaaccagcccccaccatcgtgcacataaacatcggttgcatttgkgatgatcccactcgaagagcagctaccaccgaatcaarttaacttcacatttcattcaaaattgtctcttcangaaacaagctccaggtgccatakatcattaagtaaaacaataattaaaattaggractctggcttt

SEQ ID NO: 336 - DNA, 401 bp, Artificial Sequence
  Consensus Reference Sequence
tgttaataaatttcccttccacacagttgatgcatctaaccctgaagaaaatrcaattctagtatggaagcaacaaatacaagtttgtttgtctttgtcctgctattctgatcctatctctatccagatgtatatatgtttgtatghgcatatatatatgcatccatgtatcactatcagaaaaatggctttttaggatgcgggttttacgacggttgtaaaaaatcgatgttgtaagtacatattgacaattttgtaaataattttaaaatttcaaagacgtctttgaaaatgaattacaacatcgrttcttgtagaactgatgtagaatgagcgcttcaggaatgctagcggactctttctcactctttatatttttatctttttttttatttgtctcc

SEQ ID NO: 337 - DNA, 401 bp, Artificial Sequence
  Consensus Reference Sequence
atattgacaattttgtaaataattttaaaatttcaaagacgtctttgaaaatgaattacaacatcgrttcttgtagaactgatgtagaatgagcgcttcaggaatgctagcggactctttctcactctttatatttttatctttttttttatttgtctccctatgcatgaccccaagccagtggcaagcctcccagaggcagtgtcctcgtaggtgtcrtggatgcaaacaacgttggggtgctcagagaggtggtgcatacgtcatcgtagtcctccttgcagagcagcttccgcttcgtgattgacttgcagstgaaggggcgtcccgtggcgttgtgcgtgcagargaaggttgtgccgaatttkcccatgccgagcttttagcttagggtgtagacc

SEQ ID NO: 338 - DNA, 401 bp, Artificial Sequence
  Consensus Reference Sequence
tgaccccaagccagtggcaagcctcccagaggcrgtgtcctcgtaggtgtcrtggatgcaaacaacgttggggtgctcagagaggtggtgcatacgtcatcgtagtcctccttgcagagcagcttccgcttcgtgattgacttgcagstgaaggggcgtcccgtggcgttgtgcgtgcagargaaggttgtgccgaatttgcccatgccgagcttttagcttagggtgtagacctcgcggagattctcggttyggtatgggagtacccaggtgggctttggtggtaaggccgcagtggtgccggtggtggagtttgacattgtgttcgagagagagacagagtcagtgtgtgttaattgggagaagaaaaagaaataaaggaagacccagacctggtayaa

SEQ ID NO: 339 - DNA, 401 bp, Artificial Sequence
  Consensus Reference Sequence
tggatgcaaacaacgttggggtgctcagagaggtggtgcatacgtcatcgtagtcctccttgcagagcagcttccgcttcgtgattgacttgcagstgaaggggcgtcccgtggcgttgtgcgtgcagargaaggttgtgccgaatttkcccatgccgagcttttagcttagggtgtagacctcgcggagattctcggttcggtatgggagtacccaggtgggctttggtggtaaggccgcagtggtgccggtggtggagtttgacattgtgttcgagagagagacagagtcagtgtgtgttaattgggagaagaaaaagaaataaaggaagacccagacctggtayaagtgtttaatttaatttatgaatgtgagacttgctttcatgagaaggattatt

SEQ ID NO: 340 - DNA, 401 bp, Artificial Sequence
  Consensus Reference Sequence
ttkcccatgccgagcttttagcttagggtgtagacctcgcggagattctcggttyggtatgggagtacccaggtgggctttggtggtaaggccgcagtggtgccggtggtggagtttgacattgtgttcgagagagagacagagtcagtgtgtgttaattgggagaagaaaaagaaataaaggaagacccagacctggtacaagtgtttaatttaatttatgaatgtgagacttgctttcatgagaaggattatttgaattacagatatcatgcaagaggtgtctctatctctgcttggtgaagaagtatttggagaagtcttcatytattgatagggttgaatggtccacgtactctgcagaatgaggccagaaaacccctgctcgttgtgtatccaggt

SEQ ID NO: 341 - DNA, 401 bp, Artificial Sequence
  Consensus Reference Sequence
ttcgagagagagacagagtcagtgtgtgttaattgggagaagaaaaagaaataaaggaagacccagacctggtayaagtgtttaatttaatttatgaatgtgagacttgctttcatgagaaggattatttgaattacagatatcatgcaagaggtgtctctatctctgcttggtgaagaagtatttggagaagtcttcatctattgatagggttgaatggtccacgtactctgcagaatgaggccagaaaacccctgctcgttgtgtatccaggtttgcactctgtgttagcttygaaatttaattctaatgcctttygaaataatgctgatgatgctaacaacgaaaataattgcagctgctaagcttattaaagttcctggtttttttgtaagaattat

SEQ ID NO: 342 - DNA, 401 bp, Artificial Sequence
  Consensus Reference Sequence
gtcwgcaactgtaaagccataaaacacttagttacttcttgaagttgaatgtataactgtcaataagtttagtttctaaccttacaacgttktcatttacatttctcatctcttttccattttctccttcttccctatttatcttctgtcaaagacacccttattcttaaaattgttacctttttataaattattgaatgatgatgacttcaatgtgtattttctcttttaaatttataggttgtatatttaaaatttaagcaccctgtctatatatggtttgatacttaggttcmcwgctgattataaaaaaaaatcattatttttaaaatttgtcaggtgcattacaaaacagactgctgattataaaacagatttttattctccgtttttatatagga

SEQ ID NO: 343 - DNA, 401 bp, Artificial Sequence
  Consensus Reference Sequence
tacatttctcatctcttttccattttctccttcttccctatttatcttctgtcaaagacacccttattcttaaaattgttacctttttataaattattgaatgwtgatgacttcaatgtgtattttctcttttaaatttataggttgtatatttaaaatttaagcaccctgtctatatatggtttgatacttaggttcmcagctgattataaaaaaaaatcattatttttaaaatttgtcaggtgcattacaaaacagactgctgattataaaacagatttttattctccgtttttatataggataaactgaaataaactttacctgacaaatgctacttttgtatatgctatgagttctgtttgcaggaatgrcgcataatgagctatgagccttgtatg

SEQ ID NO: 344 - DNA, 401 bp, Artificial Sequence
  Consensus Reference Sequence
tatgaattgctattttttacataattttcaatcctttaacagaccatatgcacagcagtttcattccttgcaattgtacctttgggagaattattctttttccatatgatcctgatacraaaggtatattcatgaacgacttttcctcctattgacatgtatattctaagctgtctttttcttttacagggtatcacaacatacgactatgtttgggagaattatctttccttggaaggttgtttctgctctggtattgaaaattttcccttgtcaggcaagttgaccttgttaaactaaatgagctataggcagatgagctcttacatgaagtttaaatgatgtgaacattagatagaaaatttcacaatgtgaagaaggatctgcctgttgttatttaa

SEQ ID NO: 345 - DNA, 401 bp, Artificial Sequence
  Consensus Reference Sequence
cttcatttaacctttgtcccatgatgttttttagatcaacataaaccaattatatttgtattacctaatactataatttttaacaaawtaaataaayctttgataggtgattgctactcttatgagtaactgctttttctgaaacgccaatgtgattctaattccctggtatcatatctaaaaaattctctttataatttatttttacatcaagttaatataatcatataggaaaaataatgatatttgcttgatgctgaaaaggcattattatacatggatggtgtagcttatatattagtrcagtagtagtactttcaaataaaaaattaaaaaaaaaaaaaaygaaatctctagtagtgcctaggcatatatttattatacactagctaggtgcagag

SEQ ID NO: 346 - DNA, 401 bp, Artificial Sequence
  Consensus Reference Sequence
aaatgacgatggttccttgttttgtttattaaaacatgtattatataattaggaggcctgatttttgctaccaaaattttaggtgcctttggagggttttagcgctcttcaaggaatttcaggtgcctagaggtttyagatacataaggcatatgagagttctaatcacttgccttatgctcatacttggtaccctttttgtactttttagtttattatatatcatcaatgaacattttggtgtgcgtttgatttatgggtttcatcacttgatggatcatcattatcatgtgtcttcaagtaagtaaaacagagtcttttttatgcagtttcaatcaattagatttgccagagtatccatctaaacaacattgggaagggaggttactacttgtcattca

SEQ ID NO: 347 - DNA, 401 bp, Artificial Sequence
  Consensus Reference Sequence
gtatggtcatttgatacatatacagagtgttggtcacccatggaagcaaaggtagaaagttgatcttggagattttccatattaggaatccagatattagggcatatgctactraattgccattctttcttatatgtaattataaaacctaattcaattataaagtaagtctcatacacattaggttcaattatatttgcattgttattgccattcaggaacaaaaaggaaaaaaaaataagcatcctacatcggttattaggaaaaccgatgtagcatgwtttaccatgagtagcattctatgacgtttcgcggccaggactgrtgtagaatttcggacattctacatcggttattaggacaaccgatgtagaatgttttaycatgggtaccattctacg

SEQ ID NO: 348 - DNA, 401 bp, Artificial Sequence
  Consensus Reference Sequence
tagttacttctctttaattatatttgttaagttaaaaaaattyaatgctttaagatgaattaggactcctaataaccacatcagccgtattttcycgtaattagccgcaatatataaaatgattttatgactcaccataawgtaatcacaatcataatttaaaaccatgctacttaatatgtatgtagttattttaagaagaaaaaaatatgaaatcaagatcgtgtggagtgtctaccaatctcaaggctgaactccatgccatcttttawggtctctvtcatgccttgaatctaggcttcaattagtttatgagtctgattctatagtggctcttaaactcrtcctaggaagaaattaagtaattaaccaacaagtttcatcctcacgtatgctaccct

SEQ ID NO: 349 - DNA, 401 bp, Artificial Sequence
  Consensus Reference Sequence
aacgacatcgttaagtccccgaatcccccaaaccwctcccaccagtcctcgaccaactccttcaccagctccacaccactactattgtttctcyaaaaccccccaaacctcccttgaaaccccatggcagcaatacaacaataacactaacccattttcttttttttcttctcttgwaccgtggcttcccatagcgacaacaaatctccttctctcaaaaatcactcatggatcccccttccccaaagaaaaccctcttctttgttttcatcatttcmttctcttcacctacgacacacwagtgggtttgagggccaagtgtgagagaragactgggagagaagtgaggtttgagagttgaaggaagttaytggtgacagctggcacgagtaatggcatga

SEQ ID NO: 350 - DNA, 401 bp, Artificial Sequence
  Consensus Reference Sequence
tcggtaratttttcttgcgtgtatgaatttttcttgcrttwttcatgcaaatttattttattatttttattattttttttgttgcaaaatttgctatgattttggtaaaaatatgactatttgaaggaaagagtggggtttttgtttctgattttgtcatgcaagagaggtaacaattgttagattggcctttttcttatctttttgcttttaaatttaattatcgtgctaagggagatggatataacgtagttacaacctcacaccaaacttactgtaccataataaagattacctggttcttrtagtaataatataaatagtgatgaaccacatacmttctaaaaccaaatachcatacctgtttcatatacctagtaacttagagatagaatgcaagr

SEQ ID NO: 351 - DNA, 401 bp, Artificial Sequence
  Consensus Reference Sequence
atttattatgcttttatcaattcttacrtatctacatatctatcatatttttagaataatcataycactattaatttatagkacagrggataaragataagctgaaatcatctaatccttctgaagttcacttggtacaccttttcatccttcacattgtacccgacgaaaacctcacaaataaaaattcagctattgagaaagtgtcaatttcacgtcaattaaatcaaaagttacattyagcactagttcaaatttgaacttagattcatgggtargtacagtttctccgrgccaatcaaccatatctgaaaaacaraaataartttcccaysgtcattttcactctggcctcaataathttaaggadaaattaagttagaatataacaahactgatgt

SEQ ID NO: 352 - DNA, 401 bp, Artificial Sequence
  Consensus Reference Sequence
gggcagttgaatatttcgagayrttctaactttgggagaagactactcatctcttcaggcaaygacttcaactctgatatggtcaaattaataaagttgggcgcaggcaatccttctctccagaatgatacaaagttggggcatcgatgaatgtgcaaagaacacagactctcaaatgactctgcccctgaaaccgaaagatattccatattttcacagtctgtgattgtgakatctckgagatttggaaaggtaaccratggaagagatgtgagtgaatcacaactgctttctattgwcagtgtttccagtaactcatgtttgtgttgcdtcgggaattccagttttttaagatcyttgatactcagactcttcagtgattcwggtaaacgaccaccmgg

SEQ ID NO: 353 - DNA, 401 bp, Artificial Sequence
  Consensus Reference Sequence
tctcgaaaccaaatcatcaaaatactcatgaccaacctcttctaaagtcctaccatttcttggtttcttcaaaaratcttcrgccatccacaacaagattaattcatttttttcaaaytcrtaatcttgwggatacaabgaacaataaacaaagcaycgttttaaatgtggagggagataatgataactaagtctcagtgctggaataactttacattcactttcagaaagttcccaaatgtcactattcagaatattattccaacccccaatatcatgctttcttctcaacatgcctccgagsgactgtgctgctaaaggcaatccattgcactttttaacgatctcctttccaattttttctagtgttgttgtgttctcgttagattcckaggaaagac

SEQ ID NO: 354 - DNA, 401 bp, Artificial Sequence
  Consensus Reference Sequence
gaattttttatctttcagyttgtccatcaattcaagatgaagtagattcagatcattcaakttasaaggctttccvgtcaccgcctctrttatagtttttgtgaccttgagaacatcaaattcttgagaaacacaaacccatgccttaaaatcaaatatctcttccaaattctcatcattgtacaccaattgggccaaagcagtttttccaaccccacccatgcccacaataggaatcacagacacttctctaccatcactattatcctcygacaacaacttgatkatggcctccttatctttctccctaccatatgagatccatcttccagagatgttgatggagctttccatgacacgttctccactgcactctctttcaaatcaagrctctccttgag

SEQ ID NO: 355 - DNA, 401 bp, Artificial Sequence
  Consensus Reference Sequence
gtactgtgcgtaattaagttcmtgtgctttaatgctgtgagacaagttgtattgaaryagtttgcacatgtgttttggatatttttatttaaaaaataagttaatagtaaaattgaaaatgaattttttttgttaaatccaaaasttatgtaaagatcctcracttagaatttttttctaaagttaaaatttaaaatcaaattttcaatgtgaaagtaaatagtcaaatatttacwtaaattgatgttagtttatatttcaacctkatcattaaaattgtcatagagatatgttattgtataragatctaatactraatcatgattttataaacttaaaataattgatagtgatttatgttttttaattaagwggtaaamgatttaawtttttattaattc

SEQ ID NO: 356 - DNA, 401 bp, Artificial Sequence
  Consensus Reference Sequence
aagaaaatttaagtccaryaaatgaaaatattttactatatgtaaaaaatattttttctcctatcatatttaataaatataatttytataaaatataattttattttaaatcaacaggtataaatttttatcaatagttaaaayagatttaagtgaacttcctagaaaaacttttttatttgtttgtttaagtgttgaagatatttatcctctaacttattttttctcatcacaattatttttttctttttasyaccaaacaaaaccttacaggattyttttactccactacacttgctctctcctcatttttttcaaaatacacctgcctcaaaattgtttcmtaaacaacacttctttttagcttgcagagagaaatcggggttagggaacccaacttc

SEQ ID NO: 357 - DNA, 401 bp, Artificial Sequence
  Consensus Reference Sequence
  misc_feature 384: n = A,T,C or G
acwactaacacatgaatcattcycattatcaacctcatttgattattaatccttgggaaggagacatgttacaacctaycatagttttttyacctaacaactatggtattcatwctagaaaaaaaaatgtgaaaattttcrataataaagacataacagaaaaaattatctcaatatatcttcatcttcagtttttcataaataaatattattgttcatgtattttatttatgatgtaatgtattctagtacaaataaattgttgaatatatatatataattagtttttatacattttaaagaaaatactataaacaaaaaattcatttattaatttaacttgttaaataaaaatttaatttttttaaaaagaaaaattaattncttttattttttaaata

SEQ ID NO: 358 - DNA, 401 bp, Artificial Sequence
  Consensus Reference Sequence
  misc_feature 73: n = A,T,C or G
taaacaaaaaattcatttattaatttaacttgttaaataaaaatttaatttttttaaaaagaaaaattaattncttttattttttaaatattatttttacattaaaaataaattaattttttaatattactgttttactaaatatatttttaatataaaaataatatttaaaaaaaataaaggaattaatttttcttttaaaaaataacaaaaagttaaatattattatggtggtgtgtgacttatcacgttggcctggatgctaatatagtaaagaatattttgaaaaagttgtaataataataataataataataataataataataataataataataataataataaggcgratacaagttagatcttacataatggtaattaggaaaaacaaaacy

SEQ ID NO: 359 - DNA, 401 bp, Artificial Sequence
  Consensus Reference Sequence
aaaacaaaacyagaraccccctytgataggaaagagtgatagcatagcagacaaagrgatgtattcaaaagaaatagatgtgaatcatgacatagcaactacgggagtgtctatagcaaagaagggtgcaaatcaagcagaaaaggaagtgcaagcagcagtcaataccaaaaaaaagatctcaaagccttaaggactacctgtgatcctaaggaatgatgctgaatgatctgtgctrgaagcaagggagacaagaataacgatttctgatttcctctagcacaaaaggacaaaatctgttatgtagaaatmagtataaatacaatagcatgtaataagcagcacaatatgaatgaaattagcaaattactcccctctgctcttcttcttcstctgtaggt

SEQ ID NO: 360 - DNA, 401 bp, Artificial Sequence
  Consensus Reference Sequence
tatagcaaagaagggtgcaaatcaagcagaaaaggaagtgcaagcagcagtcaataccaaaaaaaagatctcaaagccttaaggactacstgtgatcctaaggaatgatgctgaatgatctgtgctrgaagcaagggagacaagaataacgatttctgatttcctctagcacaaaaggacaaaatctgttatgtagaaataagtataaatacaatagcatgtaataagcagcacaatatgaatgaaattagcaaattactcccctctgctcttcttcttcstctgtaggttctggtgcctcaaagccagctcttaatttcctacatttatgttcagttcgtaacaattggtgctctcgtttgtcctcatgrcctcccgcaacctcgatgaggccsttrttc

SEQ ID NO: 361 - DNA, 401 bp, Artificial Sequence
  Consensus Reference Sequence
aaggactacstgtgatcctaaggaatgatgctgaatgatctgtgctrgaagcaagggagacaagaataacgatttctgatttcctctagcacaaaaggacaaaatctgttatgtagaaatmagtataaatacaatagcatgtaataagcagcacaatatgaatgaaattagcaaattactcccctctgctcttcttcttcctctgtaggttctggtgcctcaaagccagctcttaatttcctacatttatgttcagttcgtaacaattggtgctctcgtttgtcctcatgrcctcccgcaacctcgatgaggccsttrttcgtcttgacaataccatscactctatgaccctcaacatggacaagcttctcaaccrccttrctcttgtgccttcctccacc

SEQ ID NO: 362 - DNA, 401 bp, Artificial Sequence
  Consensus Reference Sequence
acaaaaggacaaaatctgttatgtagaaatmagtataaatacaatagcatgtaataagcagcacaatatgaatgaaattagcaaattactcccctctgctcttcttcttcstctgtaggttctggtgcctcaaagccagctcttaatttcctacatttatgttcagttcgtaacaattggtgctctcgtttgtcctcatgacctcccgcaacctcgatgaggccsttrttcgtcttgacaataccatscactctatgaccctcaacatggacaagcttctcaaccrccttrctcttgtgccttcctccaccacrcccaaccccacaccagtccctcaccactccacctttgttcctgtacaaatccggtatgccccatcaccgtatgargaccctrttggt

SEQ ID NO: 363 - DNA, 401 bp, Artificial Sequence
  Consensus Reference Sequence
ccatscactctatgaccctcaacatggacaagcttctcaaccrccttrctcttgtgccttcctccaccacrcccaaccccacaccagtccctcaccactccacctttgttcctgtacaaatccggtatgccccatcaccgtatgargaccctrttggtgtcctgttcaaactcactcagacgggttcagtgctaacatacctgaaggagttygaagacttggctaatagaattatyggcttgycggcccccttcctgttgccttgcttcatctcgggtttgacgctggagatccgctgcgcagtccaggcccatcagcctatgactgtggaccaggtcgccggcctcgcgaagatccaggagcagaagttgttagaccttcgtcttcctccaccgcggtcg

SEQ ID NO: 364 - DNA, 401 bp, Artificial Sequence
  Consensus Reference Sequence
aaraaatatattagataagatgaatatttaaagataaaaataaaggatttaaattaaaagatggtaaagataaaaaagataagataagaaaaataaaagataacagaaataaaagattaagataaaaaaaaaaagataagtgataacatgctaaaaatcttcatttttgatattttctcgatcttttttttcttttaatcgatcattttcatatctgcaagccataaataataaaaatatcaattcacagactaggggtgggtaaatgggtccaggtctatgaactagcccgcgrtccrtgcgagttacggaccaatttttttaaacgattcatggttatatcatatttttttgcccatcycgcttaacycgcggactatgygggtttggcccgcgaggty

SEQ ID NO: 365 - DNA, 401 bp, Artificial Sequence
  Consensus Reference Sequence
aaaagataacagaaataaaagattaagataaaaaaaaaaagataagtgataacatgctaaaaatcttcatttttgatattttctcgatcttttttttcttttaatckatcattttcatatctgcaagccataaataataaaaatatcaattcacagactaggggtgggtaaatgggtccaggtctatgaactagcccgcgatccrtgcgagttacggaccaatttttttaaacgattcatggttatatcatatttttttgcccatcycgcttaacycgcggactatgygggtttggcccgcgaggtycacgggttgctcgcagcccacattaggtttgatttgtgtgaccytgacycaattatattaggtttgattttctcttttttactttaaacttttc

SEQ ID NO: 366 - DNA, 401 bp, Artificial Sequence
  Consensus Reference Sequence
ggcttaagctacttcaaatatgraatcatttgttgttggagatgtttaaatttcatattttaratttatttcttggattttcttttgttaagacattatttattttattgatgtaattgactaattattgagattttatttacakctrtattgaacttaatttgattgtattrtatttttattaaaattgaaattcttttaaaactagtcccgcggaccggcccatttgacccgtggggtctgcagggcggggggcggaccaatttatttcatccgtgtaagaagcggcgcagacggcgcgagtcggcycgcttacccacccctaccgcagacccattgggagatyagttggaggacatgattcgtgaccttggacaagagtctttccagcaagcacacgc

SEQ ID NO: 367 - DNA, 401 bp, Artificial Sequence
  Consensus Reference Sequence
ggtgttaagtctggttaatgtgaaggchagatwtgggtggagtgacaaaagtttcacctcactgcttgaggtagtgcacaatytgcttcyagaggacaacacrttgcctaaaagtwactataaggcgaaaaagatattgtgtccgatgggtatggagtatcaraagattcatgcttgyccyaatgattgcatactgtacagrcatgaattccaagaaatgtcsaaatgccctatctgtgggacttcacggtacaaagtgaaggatgaagaggaaagcagttctratgaaaactccaacaaggggcccccagcgaaggttttgtggtatcttccaatcattccaaggtttaagcatcttttttctaatgaggacracgcaaaagaccttacatggcatgcaa

SEQ ID NO: 368 - DNA, 401 bp, Artificial Sequence
  Consensus Reference Sequence
tgcgtcctgcacaggtcggtgctctgcatatggcatccagcagacgtctgggatccttagacaatccaggcrctgcctgtacgtcactatagataccttcttcatagtcttctttgtggcaatacaacggcacrcacacggtgacacctcaactgacggaaagtgctcgtagatccaacactacaggrtttacatgaaaaacatacatgttaactaaatatacactcattaaaacattgttgtaattaaattatgaaatacatgttaattacttgtaacaaggtgatgtaaccagcaagctgtcgactggtgctgagactgacatcgttaagttgatcgtacatatggacgaggccaacagctcgccatgcataccgccaagcaagattgaggtcacgtag

SEQ ID NO: 369 - DNA, 401 bp, Artificial Sequence
  Consensus Reference Sequence
agaccatcaatagttcaaccaagagcagcactgcctcgtcgctgcgcagaggctggaagtcatgcaatgcgccaacgatcgacagatggagaagagacgsgacatcgtccaacgtgatcgtaatctcccccacgggaaggtggaaactagaagtctcccggtgccacctctcgataaaggaggatataagtccctgatcgccagtgtcaatcgaacacgagatcaaaggacttaatcctatcccaacaatcatatcctcaattgcaggaayaggtttgcctaagttatgcaccttcctcccatgggaggataacttcaactcaggacgttcctraattraagtacaaatgaacacaatttattcaaagaatgtgaatcagtaaccaataaataaataaaaa

SEQ ID NO: 370 - DNA, 401 bp, Artificial Sequence
  Consensus Reference Sequence
caccaggaaatccctcaggctcatcctcaatatcctatgcaccagtatcctgtgcgtcagtctctgcaccggtgtcctgtgcgatagcatctgccatggactcatccccagctacaacagcctctgcctctagtaccgcaggcgagtccgtaggtaccacatgcacatcatcgtcaacaatgactggtacccgtcgcctgcgtgccgatgcggtcggccttcaacgttggggagcaccgtcagtatcatcaccatccgctcctctccccagacctttggcaacaactctacctaatgcatggcctagtcctctagtcttaaccatgatttgcaaatttagaaatttagaaattttgtttatgtgtagatttttatctatttttaacgtattttaattggat

SEQ ID NO: 371 - DNA, 401 bp, Artificial Sequence
  Consensus Reference Sequence
agcattttgatggtggaaaggctcaaacacaagtgagtgaagtagttatgtgttgtttgttaggtttcctaaactcatatctagctaactaaatagctcctcaagatccaagaaagaagagtcaaagacaaacatgacaattttcagacaatattcatcaaagcaattttgataacatacaaacaaagatggcaagtggtgtttattgccttcaaatctttaaatttatacttgcgaatcaagttgatccgcatgaagctcgcggatcaacttgatccacaggaagcatgcggatcaaccttttcttcttgtggatcaacctgatccgcaagttcaacacaacataattaaatacaacctacagatcatctaccctatttgcggatcacctagttcctaac

SEQ ID NO: 372 - DNA, 401 bp, Artificial Sequence
  Consensus Reference Sequence
atattattggatgccactctcatgtcatyaatatttgtacaaatgattatttttcattttctgtgtgagtgatatttgagataggaccatttgtaggcctgacttggttagtaggaaaacattcatcatgtatcttgagggtaaaggttcctgtattgaattatgtttgaaagtcttcatgtttaaataatcatataaagctatagtgttagacgttcttgctcttcctttatgctcttcatctttcgagrggtttaaaaatktagaacttatgatataagctcctttgctgaaatagttggtttatctcatgagtgtgaagtaggaagtataaaaaaaaaaaaaaaaaaaagttgctctgttgtgaagtcgtatgttctttttgtgggctttaactagtc

SEQ ID NO: 373 - DNA, 401 bp, Artificial Sequence
  Consensus Reference Sequence
tttagcctctcattgtcataggaggccttacaattgcaagaggattatgaatataaaaaggaaataaataagcaaggaaatggaggaaaggaattgtattcttgtataatttttgtgtgttttttttcttcttctctctccttcttttttttataggtgtatattaatttaattttcacgcaaccttcgtgctgagcatgattgtcctacttagcgagtatgacggtaacctcttactaaggacatctctttccagaattagactgatttcctaaattagttctacttcctaagcgcctgagacgtgcttagcgtgccactttagaattycaatatgctctctcggaccttactttgttcactaaacatcataaattcattcacttttaatatttcataca

SEQ ID NO: 374 - DNA, 401 bp, Artificial Sequence
  Consensus Reference Sequence
  misc_feature 341: n = A,T,C or G
tcttctctctccttcttttttttataggtgtatattaatttaattttcacgcaaccttcgtgctgagcatgmttgtcctacttagcgagtatgacggtaacctcttactaaggacatctctttccagaattagactgatttcctaaattagttctacttcctaagcgcctgagacgtgcttagcgtgccactttagaattccaatatgctctctcggaccttactttgttcactaaacatcataaattcattcacttttaatatttcatacacaaaaacttaaatgatgataaaataataattatttgtacaaaaaggaagaagtatgagaaaaaaattancaattcctatataatttaatcccaaaatatacctataaataaatttataattcaccatta

SEQ ID NO: 375 - DNA, 401 bp, Artificial Sequence
  Consensus Reference Sequence
  misc_feature 74: n = A,T,C or G
atacacaaaaacttaaatgatgataaaataataattatttgtacaaaaaggaagaagtatgagaaaaaaattancaattcctatataatttaatcccaaaatatacctataaataaatttataattcaccattaatattataatggagataagtaaaaaaaaagtaattaatgttatattgaaaaattaaaataataattattttgagatatatttttattttttccttaataattataacagggygagagaaatatttatatataattttataaaaattccyataataatttttgtaaaatgaaaggaaaagataattatgaaatgtaatgagatataaatttttattaaaaaaatatacatttttttttcatataactctttttttccttctttctcat

SEQ ID NO: 376 - DNA, 401 bp, Artificial Sequence
  Consensus Reference Sequence
  misc_feature 29: n = A,T,C or G
aaaaggaagaagtatgagaaaaaaattancaattcctatataatttaatcccaaaatatacctataaataaatttataattcaccattaatattataatggagataagtaaaaaaaaagtaattaatgttatattgaaaaattaaaataataattrttttgagatatatttttattttttccttaataattataacagggcgagagaaatatttatatataattttataaaaattccyataataatttttgtaaaatgaaaggaaaagataattatgaaatgtaatgagatataaatttttattaaaaaaatatacatttttttttcatataactctttttttccttctttctcatcacaatatctcttattatatcctacatttttctataacattttcc

SEQ ID NO: 377 - DNA, 401 bp, Artificial Sequence
  Consensus Reference Sequence
aattacgtacccatgtaatacagtgttagttaattcacaatttttttaaaaattattattaccaaaattttatgatatcatcgatgtttatatttttatttcttatatatatatatatatataaattattacattacttaaaattatttatgaaaaataaatttaattaaatataatattcagtaactattcaagtatatataaatataattatcaacttgtaacagagatatacttttagtttttttttagaaaatattattattagctttaaaatgttttatatatgtgatattttaaattactttgtatcacaattattatatatgttaaatatttgttttctttgaaaaaaatataaataaaattaaaacttaaaattgagattaatccatacatgc

SEQ ID NO: 378 - DNA, 401 bp, Artificial Sequence
  Consensus Reference Sequence
aaaatgttttatatatgtgatattttaaattactttgtatcacaattattatatatgttaaatatttgttttctttgaaaaaaatataaataaaattaaaacttaaaattgagattaatccatacatgcatatataatcatatttaaattttaaactacatcaatcgcacaatgaattaagaaaaccaaagattgtatcaaatgatatttctctttttcaaaaccaatctactccataaactcctcggacggctattaggaaagtgaaaaggaaaatataaawaattaaaaaaataaatartttgactttgtagaagtcataatcacattctttatcattcttctcttctccatcccctcattgttrcacctgatacatttatttctttaacacgtcctat

SEQ ID NO: 379 - DNA, 401 bp, Artificial Sequence
  Consensus Reference Sequence
gcacaatgaattaagaaaaccaaagattgtatcaratgatatttctctttttcaaaaccaatctactccataaactcctcggacggctattaggaaagtgaaaaggaaaatataaawaattaaaaaaataaatartttgactttgtagaagtcataatcacattctttatcattcttctcttctccatcccctcattgttacacctgatacatttatttctttaacacgtcctattttctgatcaatatgaaaataatatattgcctctttgttttctgatcatgctattgcactgatgtattttctgttcttatcatgattagttccacattattrttatgtcatgcacttcatctcatcatggtgcgttgcactaatattaatgatygttctayaaatc

SEQ ID NO: 380 - DNA, 401 bp, Artificial Sequence
  Consensus Reference Sequence
gattggcatttttctcatctttttgcttttaaatttaattaycgtgctaagtgagatggatataacgtagttacaacctcacaccmaatttactgtaccataataaagtgtrcctgcttcttgtagtaataatataaatagtgatgaaccacacaccttctaaaaccaaatacccatacctgtttcatattcctagtaacatagagatagaatgcaaggcttgtattattcactctcctatatatttatttaccaaactttggtggaaattttatgaagtgacaggttcatattagcttttaaccatcmatggaaaactggaaaaaagaaaaggctggcactaacaaccagttatttgtcaataggaaaggaagcttgggccaaattgaaggatgttgtgg

SEQ ID NO: 381 - DNA, 401 bp, Artificial Sequence
  Consensus Reference Sequence
ctattgactagaaatctagaaaaaaaaccatacggtaaaagcgatcacatccattcccaataaggcaggcaactcgttctccactcttcaagattctcttctacatactcaccggcaaagactaagttaatttgatgacttatcttagtttcttgcttacttgccagaaaaactttttggctagtctgattctgtttcgtacctgcagtaaggactccatctccatcaacctaagttataatcaacctcgtaactataaactttctatccaaatatgcttttataaaaattattaacatgcaattattaagtttttatatcatctcaacgtcacagtcatttccaatcacactacataaaaaatcatgatttatcggacgctaaattctttaactcggtcg

SEQ ID NO: 382 - DNA, 401 bp, Artificial Sequence
  Consensus Reference Sequence
  misc_feature 253: n = A,T,C or G
ggtgaagccagcctgtcgaaaascacatcaagraaagcagagagaaaggcaccacckaccactkctgctgccattatctcaagaacaaaagatgatcagagwagaaasacraagscaaggaattggttgctacgaactgggttggttcttggtaaggttaactgatgtgatgagatttggcttaagtttactcgttctgccgtgcaagacaaaagtacggtttatttatttattattattattatggtggtgngtgacctatcacgttggcctggatgctttttgggaktctctttacttttgttccysttcaaattactataaatttctagaatatgtttaaatataatatgtatgaaaatagtagaatattytaaaactatagtgtgtatgaatatagt

SEQ ID NO: 383 - DNA, 401 bp, Artificial Sequence
  Consensus Reference Sequence
  misc_feature 146: n = A,T,C or G
sacraagscaaggaattggttgctacgaactgggttggttcttggtaaggttaactgatgtgatgagatttggcttaagtttactcgttctgcygtgcaagacaaaagtacggtttatttatttattattattattatggtggtgngtgacctatcacgttggcctggatgctttttgggaktctctttacttttgttcccsttcaaattactataaatttctagaatatgtttaaatataatatgtatgaaaatagtagaatattytaaaactatagtgtgtatgaatatagtagagyaatttagaactataatgtgtatgaatatggtagaacaatctagaactataagtataagacagaataatctagaactatcatgataytaatctatcatgaaaa

SEQ ID NO: 384 - DNA, 401 bp, Artificial Sequence
  Consensus Reference Sequence
  misc_feature 145: n = A,T,C or G
acraagscaaggaattggttgctacgaactgggttggttcttggtaaggttaactgatgtgatgagatttggcttaagtttactcgttctgcygtgcaagacaaaagtacggtttatttatttattattattattatggtggtgngtgacctatcacgttggcctggatgctttttgggaktctctttacttttgttccycttcaaattactataaatttctagaatatgtttaaatataatatgtatgaaaatagtagaatattytaaaactatagtgtgtatgaatatagtagagyaatttagaactataatgtgtatgaatatggtagaacaatctagaactataagtataagacagaataatctagaactatcatgataytaatctatcatgaaaac

SEQ ID NO: 385 - DNA, 401 bp, Artificial Sequence
  Consensus Reference Sequence
  misc_feature 80: n = A,T,C or G
gatttggcttaagtttactcgttctgcygtgcaagacaaaagtacggtttatttatttattattattattatggtggtgngtgacctatcacgttggcctggatgctttttgggaktctctttacttttgttccysttcaaattactataaatttctagaatatgtttaaatataatatgtatgaaaatagtagaatattctaaaactatagtgtgtatgaatatagtagagyaatttagaactataatgtgtatgaatatggtagaacaatctagaactataagtataagacagaataatctagaactatcatgataytaatctatcatgaaaactctagaaagacctaaagtaatgtagaaacatttaccaccattgagaggttkgtgactttataaat

SEQ ID NO: 386 - DNA, 401 bp, Artificial Sequence
  Consensus Reference Sequence
  misc_feature 48: n = A,T,C or G
aagacaaaagtacggtttatttatttattattattattatggtggtgngtgacctatcacgttggcctggatgctttttgggaktctctttacttttgttccysttcaaattactataaatttctagaatatgtttaaatataatatgtatgaaaatagtagaatattytaaaactatagtgtgtatgaatatagtagagcaatttagaactataatgtgtatgaatatggtagaacaatctagaactataagtataagacagaataatctagaactatcatgataytaatctatcatgaaaactctagaaagacctaaagtaatgtagaaacatttaccaccattgagaggttkgtgactttataaataggcaattggtatgttgtaattaatcaatcca

SEQ ID NO: 387 - DNA, 401 bp, Artificial Sequence
  Consensus Reference Sequence
tctttacttttgttccysttcaaattactataaatttctagaatatgtttaaatataatatgtatgaaaatagtagaatattytaaaactatagtgtgtatgaatatagtagagyaatttagaactataatgtgtatgaatatggtagaacaatctagaactataagtataagacagaataatctagaactatcatgatactaatctatcatgaaaactctagaaagacctaaagtaatgtagaaacatttaccaccattgagaggttkgtgactttataaataggcaattggtatgttgtaattaatcaatccaagaaatcaatgacatagcattctttctaaaataattctctaaaactatcaattatcaactatcatctaatcaactatcaacagttt

SEQ ID NO: 388 - DNA, 401 bp, Artificial Sequence
  Consensus Reference Sequence
ttrcctaaaaatacttaactaagaattarttctaaatttaaaatttaaaatcaattcctcartstgaaagtaaatagttgaacatttactcaaatcatgttagtttatatttcaacataattttagaaaatcaagcataaaatctaatatacttaattaaaattgtcatagagatttgttgttctagaaaggtctaatagcgaaccatgwtctcataaacaattgacattagtagtagtagtttgtatttcttaatcaagtgktacaagattcaaatcatgattaatcyttacatawagaataaataaatatgaaattaaaaaatattaaaccaaaacaaaargaagtattgaacaaataaaaagaaagaatwgaacaaadgrcacatgctaattgatccc

SEQ ID NO: 389 - DNA, 401 bp, Artificial Sequence
  Consensus Reference Sequence
ccaaatcccgattggaccggtctgatctggccgattttamaaaaaaaaaaaaawagaccacttcaatggtgttgttttgatgtcttattattatcaattgttatcttggattatgaagtatggatgattttttttttttgctcaaataatgttagttatatacttatatatagttttgaatttttataatatatcaggtcaaaccagtccaatgactggtccaacactaytgacccactcaccaactattttgatttggtcaatgatccaactgggttttaaaactagcttaaaacaaacataatattgatttaaaagctgattattatgtttattttaacttatgtttgattttctattttttaaaagtatttattataatgttaagtttataacaatta

SEQ ID NO: 390 - DNA, 401 bp, Artificial Sequence
  Consensus Reference Sequence
cttaacgtcaaatttgtaaattttttcctttttttttcatctgaaaattttaatttgttgccaatatgtattgacaataactcagtgcatgtgacccaagcatgaaaattggtagatagactgccaaagttaggtaacgattgtaatggaaagtggaactacatgcatctgaaaaaggtgccaactcagttatatttataattgcctatttgaaaccttactgaattttcgttttcttcttgagtgccattaaagtctcccaactttagaagattaatttgggcagatgagtgtgaatgacttgatttgtctatgtaattcaaaacagaatgcaggtctcacttgtttgcatgttccttttttacgaatctcaagttcattattgatrtattttgttgtat

SEQ ID NO: 391 - DNA, 401 bp, Artificial Sequence
  Consensus Reference Sequence
agaagtttcaagaatttcattcaggagattagattctctgacaatcatcccaacttattaaatttgttcatctttctttcaggtgtgtctttcattgtatattctgctgctgggtaattggaaggctaaccaggtgctgyttcattccttaattattcttcaaacwttccaagaagtccatattcttcattgttctctagcgtcatcaccaaaatcarggaatgctgaaagatgcgctkgacagttamgaattccttcaccgaggctaatgagttcgtgcctccatctgagcwatccttgttcaaccttgatgacattggatstttwgtccactgtccatatctatttttbgctcgagcgactgaggtgcraagaaatctcagccattgtgcaccagatgt

SEQ ID NO: 392 - DNA, 401 bp, Artificial Sequence
  Consensus Reference Sequence
aaagacaaggatatcaatkgccaaaatcatggaaagttcttggttcaaaaggggkttagagaagyctaccattactcrgaackaagaccaagaactggctcctctggatgcattatttgtgaaaaaattgttttattatgtgaaaaaatctcatcactttaaaatttaaagttaagaacaagagaaatttataaatatttaatttctcaaccaagcaagactttatttaataataacaaaatcatgaaacaaattcaaagcaaaaagtatttcaaatatagtctacacatataaaagaatttgacatcagactaaaaatataaaactcaaatactaatttaagagtgtatttcaaattactcccttctaaactcaaatacgaataaatttaactaaaccca

SEQ ID NO: 393 - DNA, 401 bp, Artificial Sequence
  Consensus Reference Sequence
tcaaatacgaataaatttaactaaacccaaatcttttctgttaatttttttttcagcttaaaaacataacgcataaactagaaatatgattaattgttttatttgtattaaaattattttaattttaatataatattttatattacttttcttatatttattatgaagtaaaaatatttgaaaattaaagtaagaaaataatatcataatagaaataaaataattaatactataaaaggaatgcattattttcagtgaatcttttaccattgcaaaatgaaagacatgtattaaataaatttattaatgatattagacatctaatttcatgaggttagttaagtggaatcggatatastcttgtatctagcaaattcaaggtttaagtttatatattacag

SEQ ID NO: 394 - DNA, 401 bp, Artificial Sequence
  Consensus Reference Sequence
gcattgtatcaataatgacttgtatttgttaaccaaacattaacccttacgcataaaattaaaaaaagaaagcatgttaattgatccctaaaarcataatattaatgaattaaagattttaatatctttatatatatgtatgtatgcaaaaagaaaagtgggtgatttttactaaataaaataaataaataaataatagacactaatatactataataagttttgacatgtagatatccccatgattttatatttatattaaaaaaataggcttccagatatgaaaaataggactcagagagaaggggagtgggggatacaagccagatcttgagaatggtaattaggaaaaaacaaacccagaccccctccctttcctaaggaagaacttatcatggcac

SEQ ID NO: 395 - DNA, 401 bp, Artificial Sequence
  Consensus Reference Sequence
catgtggactrgattgtgtaccaatctcaaggctgtgaactccttgccatcttktatggtctytgtcatgtctgsaatctaggcttagggatktagtttgtgagtatgattctacagtggctcttaaactcatcttrgaagraaccagcaagtttcaccctcatgctaccctcatcaactcaattaatcaactttctggcaaaagcaacgtctgtgcaaattggcttgctaatttaagtttggagcctcaagctastgataattcatttctggtttggcaacattgcccacctaaactrkctttgtctcttttagmagatgcaggywgagattcttattagattgtgtacgygtgtttagtttgctttgcttttttaagttttctgatgcataaaaaatta

SEQ ID NO: 396 - DNA, 401 bp, Artificial Sequence
  Consensus Reference Sequence
tggtgtcctcattggtccacagacatccrtatttatcagctccaatagatctttcgctctccatgctccacttgttgagaaaggaaatcagtgttgcttaccaaggagacatccttcacacactccattgttctcctttatgcttggaagatctctcatcatgttcttctcatgtaacaacttcaaggcgtgtgtgttgaagtggccaaatcttcgatgccatagccatgaatcatcaacttgtaccttcatggcaatgtttgttgcatattttaaatttwgagggaagcttctattgctcttattcatctttacttgggctatatctcagaccttttatttttgttgtctaagattttgcatacacctccttcaaagtgaagtgtgtagtctctctccat

SEQ ID NO: 397 - DNA, 401 bp, Artificial Sequence
  Consensus Reference Sequence
tacatccactatccaagtaccagcttcctcccttttcttttattgagtattgagtggcatagaacatacattattcttgatcatgctcctttgcgatattggcttgatgcctatttttgttgcgacaatttttctctatgtgcccgaacttcttgcaatggttgcattgtggcatattacagaaccaacaatttttctctgcgtgaccttgccttttgcatatattgcatggaagatttttatctrttttgttcttaaggaaattcctagaaccttctcttcttytggaagtttctccataattttttttcctccattttctttgttttggggatgaaatttaaactttgactggaaggcattttcaagtgtatcttttttatgcctatacagtctttgct

SEQ ID NO: 398 - DNA, 401 bp, Artificial Sequence
  Consensus Reference Sequence
agtattgagtggcatagaacatacattattcttgatcatgctcctttgcgatattggcttgatgcctatttttgttgcgacaatttttctctatgtgcccgaacttcttgcaatggttgcattgtggcatattacagaaccaacaatttttctctkcgtgaccttgccttttgcatatattgcatggaagatttttatctattttgttcttaaggaaattcctagaaccttctcttcttytggaagtttctccataattttttttcctccattttctttgttttggggatgaaatttaaactttgactggaaggcattttcaagtgtatcttttttatgcctatacagtctttgctcatatgcttcaagagagcccacaagttctgtccttgatagagtgg

SEQ ID NO: 399 - DNA, 401 bp, Artificial Sequence
  Consensus Reference Sequence
gatctttggtttccccaatcgttgtcacgattgggktaaatttttggggcatagtaattagaattttctcaataattttcttgtcaagaatatcctccccaaaagctctcatttgattaactatttctttaactttagaatagtaatctttaackktctgagactccttcatctttaatagttcaaaatctcttcttaaacattgaattttaacggcacgtaccttaacacttccttgaaactcctcgtgcaatgtgttccatgcttctttagcagtcttagctcccataattcttgggaaaattggatcastcaccgcttgttgcaaggtgaacaacgcctttgaatttttctgtttatttttcttcaactctttttcttgagatgcattaagaactgaa

SEQ ID NO: 400 - DNA, 401 bp, Artificial Sequence
  Consensus Reference Sequence
tttgattaactatttctttaactttagaatagtaatctttaackktctgagactccttcatctttaatagttcaaaatctcttcttaaasattgaattttaacggcacgtaccttaacacttccttgaaactcctcgtgcaatgtgttccatgcttctttagcagtcttagctcccataattcttgggaaaattggatcactcaccgcttgttgcaaggtgaacaacgcctttgaatttttctgtttatttttcttcaactctttttcttgagatgcattaagaactgaagtatccrcggaacagtgaagccttcttctactatgtttccattttaacacgccagaaagcataattttcaccattgaagatagggacaaaaatagttgacaattgagtagt

SEQ ID NO: 401 - DNA, 401 bp, Artificial Sequence
  Consensus Reference Sequence
ttttaacggcacgtaccttaacacttccttgaaactcctcgtgcaatgtgttccatgcttctttagcagtcttagctcccataattcttgggaaaattggatcastcaccgcttgttgcaaggtgaacaacgcctttgaatttttctgtttatttttcttcaactctttttcttgagatgcattaagaactgaagtatccacggaacagtgaagccttcttctactatgtttccattttaacacgccagaaagcataattttcaccattgaagatagggacaaaaatagttgacaattgagtagtgttatccatagcttagaaaaaatattattggagtaggttaatagtacaaaggaaatttttgaagtagttgggagggttttggaatagtaggtaggt

SEQ ID NO: 402 - DNA, 401 bp, Artificial Sequence
  Consensus Reference Sequence
cakatgtrtgrcatgtattttatgtctcaaaacacttatgtgaattttattatgtaatacatgttttgaattcattggattcttatgtatcatctgtgccaatttttatgggcttaacatctctgactgaaatgagcaagtccaatttcacctcggtgttttggatcatgatcttgctatgttggaagagaagtttgttactattattgatgctagtagcaataaagagaaagttcattataaagcttgggaaagatctaacagactcaacctaatrttgatgaaaatgactgttgcagacagtattaagacaactctccctaaaatcgaaagtgctaaaagttttatgggattagtgggagagcgctctcaaacagctgataattctgttgctgggacat

SEQ ID NO: 403 - DNA, 401 bp, Artificial Sequence
  Consensus Reference Sequence
taatrttgatgaaaatgactgttgcagacagtattaagacaactctccctaaaatcgaaagtgctaaaagttttatgggattagtgggagagcgctctcaaacagctgataattctgttgctgggacattaatgagtacattagccaccatgaagtttgatggttcacatactatgtatgaacatgtcattgagatgataaatattgcagcaagacttaagaccttgggaatataatggctgtgaatgagaaccttcttgttcaatttattctaaactcattaccgtctgagtttggcctgttctaaatgaactataataccatgaaagataaatggratgtgcatgaattgcacagtatgttagttcaggaagaaacgaggcttaagaatcaakgaagtc

SEQ ID NO: 404 - DNA, 401 bp, Artificial Sequence
  Consensus Reference Sequence
tgagtattatggaagatatgatgaaactggryaacacccaggtccatttgctaagcttcttcaaaaacgtggcatttgtgcacaatacacaatgtctggtacaccaccacaaaatgatgtatcagaaaggcgtaatagaacattaatggatatgattaggagtatgttaatcaatttgactttacccgtatctttgtggacgtatgccttgaaaactaccatgtatttgttgaatagagttcctagtaaggcagttccaaagasacctttgaactgtggacaaatagracacctagtataaggcacctgcatgtttggggttgcyagrcagaaataagdatttayaatccgcaagaaagaaaattggatgcaagaacaatcagtggctatttcattggtta

SEQ ID NO: 405 - DNA, 401 bp, Artificial Sequence
  Consensus Reference Sequence
cttaagtgtkttttttagttattcatttcttgattataaaaaaaaattagtcagtgaatgaacagagaactacactttaattgaaagtaatttataatcatttattattattatttaatttcaagtatgcactcaaaacaattgcactttatagtcactactaaaataaagactttttatgacacacttttaaaatcggtcgcaacatgactgtcgtagtattaggggcggtagcatttttataaatatcttatatattcaacgacgtttttgtttaggaccgttttcgtatgctaacgaaaaaattgactaagacagtgtatattaaacatgtccttgaaatcactaaaaacaaatacgggcttcaatatgcaccctcgttaaccaagttttataaaagc

SEQ ID NO: 406 - DNA, 401 bp, Artificial Sequence
  Consensus Reference Sequence
cggtagcatttttataaatatcttatatattcaacgacgtttttgtttaggaccgttttcgtatgctaacgaaaaaattgactaagacagtgtatattaaacatgtccttgaaatcactaaaaacaaatacgggcttcaatatgcaccctcgttaaccaagttttataaaagcttcttgtcccgtgagtgagtgagttttcgagtgaacgaaaacttccgaygctagatcttccttgtgagtgagcttctgagtgaaccttcgaaaacttcccgcactacatctcgcaacaccttcacacctctgacaattatgtgttcgaaataataggtgcaggcaagacctgcaatctctaaaygcttaatagttatgtttagaaaataactactttagaaatcatct

SEQ ID NO: 407 - DNA, 401 bp, Artificial Sequence
  Consensus Reference Sequence
ccaagttttataaaagcttcttgtcccgtgagtgagtgagttttygagtgaacgaaaacttccgaygctagatcttccttgtgagtgagcttctgagtgaaccttcgaaaacttcccgcactacatctcgcaacaccttcacacctctgacaattatgtgttcgaaataataggtgcaggcaagacctgcaatctctaaacgcttaatagttatgtttagaaaataactactttagaaatcatctatgtattaaaaacttcagggtgacagttatgtctcaattgctactgtttaaaacataccggtatgttttataatatgaaatgtttcaattaattttaggtaggagcatgtggttcaaatgtctgcatatatgttgatcaagaggttggtaaattaa

SEQ ID NO: 408 - DNA, 401 bp, Artificial Sequence
  Consensus Reference Sequence
agcttacatcagaaccgtttttgaaagttagcattctaaaacggtgtttaccttagcaacgtcttaaaatgcttactttcaaagacggtgtttaccttagcaacgtctttgaaagtaagcattctaargcggtgctcacatcagcaacaacaacgtcttagactgtctactttcaaagacgttgttgaagtaagcaccgtcttagaaagctgctcactttctaagacagtgttttggaactcgtcgttgaaatttttaaacttcgacgacgtcacattcaacgacattcaaacgtcgttgtatattctatttgaccgtcgttaaagcactttcttatagtagtgagttaattatgtttttgcttttgataacatcawtgtttatggmtaattttaaacatt

SEQ ID NO: 409 - DNA, 401 bp, Artificial Sequence
  Consensus Reference Sequence
agtgatgaatcacataccttctaaaaccaaataccgatacctgttttatatacctagtaacttagaggcaaattttcccattcgggatacttttaaaaagtatttccccagatggggttgttttaaaagatattccggcaagggaaacttttgcacgtaaagtgcatgcatggcccaagcaaaccgcyagtgggactggcgggttctctgctggtgaaggactcgccactgcgaatggcgatatgcacatgcaaggggaaccgccagtttgactggcgagttcccaccacgtaggctcagggctaggcgtyaggccatgcaggtgcagcaggcgcaggtgcagagagtgcaagagggaatcaccattctcattgccgggttgggctttgcgggaatcgcca

SEQ ID NO: 410 - DNA, 401 bp, Artificial Sequence
  Consensus Reference Sequence
  misc_feature 185: n = A,T,C or G
ttaaattrtatgttattagttgtgttatatatatatatatgttaggttagttttagttaatttgataatattatttttttaaaattttgtaaattagtatagtattaattgttttatatatagatatgctaagtttgttgatgttaggtgaaacttttaaattttaagtagtaygttcaaatatnaatatkatttrtgttatatgtatatgttacaaatttkagttggtatattattatttgtacgttagttgtagttgatttattaatatgattttgttaagatttttwaaatttgtatgttattatttgtgataaaattatttgtacgttaattttagttgttatgttattgttatttrgtttagatttattaggtttgtatgatattatttgtattat

SEQ ID NO: 411 - DNA, 401 bp, Artificial Sequence
  Consensus Reference Sequence
  misc_feature 25: n = A,T,C or G
attttaagtagtaygttcaaatatnaatatkatttrtgttmtatgtatatgttacaaatttkagttggtatattattatttgtacgttagttgtagttgatttattaatatgattttgttaagatttttwaaatttgtatgttattatttgtgataaaattatttgtacgttaattttagttgttatgttattgttatttagtttagatttattaggtttgtatgatattatttgtattatatatatggtattttaggtttagttagaatgtgaatattatttagtttatttaattatagtttttattgaaatatatgatactttattaatattatatatatacgttgtttaaattttttattccataataatttttttatttattaccatttttgtgtat

SEQ ID NO: 412 - DNA, 401 bp, Artificial Sequence
  Consensus Reference Sequence
atttgtagagtattttagagmatttatttaaatttgtgtacatattattatttttaattttgttatttgtttaaattgatgtattttgttatttgttcaaattgatgtattttgttatttgttcagattttaattatgtggtatrtatatttaattgattttttgtaactgtagttaattattttaatgtaaaatttttgctgtcaattttttgtattatattttattttacagtatcaatggcatcttcgtcgtcatcttcatctagtatacwcattaagtctrgtccaatagatwgagacgttttatggatgcaagctaaacatgtttcagaacatgtttggaacggggaatcagacagaaaattacacatcagacgagytgtccccatctatcaagga

SEQ ID NO: 413 - DNA, 401 bp, Artificial Sequence
  Consensus Reference Sequence
  misc_feature 83: n = A,T,C or G
tagttgtttttwaaaaaaaagtcatttgaaaataatcaataatgtaacgcatcgccactaattatttcatattttttttgtangtggctgcgacgtggaaaccaacatattggcaatgatgatctaatagttttycgtcgcaaattggatatcatgaaacgacatgaggtaagaaratyrttatgtattcgttaaataataaataaaatgtcatgtttaagtcaaaattaacaattgtgttattgtatgmagtttctgtgggasycttacacarcaactgttatgtcaatgttgcctcccatttgtttggttggtagtgtggcgtggtgcgcagtggtkccactcatttgtttccatgttgtagagtggcaccaacccaatagagtgttgcgacaatttgg

SEQ ID NO: 414 - DNA, 401 bp, Artificial Sequence
  Consensus Reference Sequence
  misc_feature 10: n = A,T,C or G
ttttttgtangtggctgcgacgtggaaaccaacatattggcaatgatgatctaatagttttycgtcgcaaattggatatcatgaaacgacatgaggtaagaaratyrttatgtattcgttaaataatraataaaatgtcatgtttaagtcaaaattaacaattgtgttattgtatgmagtttctgtgggasycttacacaacaactgttatgtcaatgttgcctcccatttgtttggttggtagtgtggcgtggtgcgcagtggtkccactcatttgtttccatgttgtagagtggcaccaacccaatagagtgttgcgacaatttggaatgcaacaacctatttcagagtctccttcgtaaccatagaatatccatgggctaacgctgaaaggcaaacaa

SEQ ID NO: 415 - DNA, 401 bp, Artificial Sequence
  Consensus Reference Sequence
agttaggttttagggcttaggtttrgggtttagggttagtggttagggttagggtgtaggttttggggtttgggtttagggtgtaggttttagggtttgggtttatgtttatgtttttaactaagtccatagttcatcattgtatatagttctcctttagtatcaatttgaataccctttcatcattgtagatagttctcctttagtatcaatttgaataaccttaactacarcattkgactccccactttcactaagcctaggtttagggtttagtgtttagggkttrgggtttaggggttagggtttgtggtttagtgcttagggtttagggtgtaggccttaggstttagggkttattggttagggtttggggtttaggatttagggtttggggttta

SEQ ID NO: 416 - DNA, 401 bp, Artificial Sequence
  Consensus Reference Sequence
kgactccccactttcactaagcctaggtttagggtttagtgtttagggkttrgggtttaggggttagggtttgtggtttagtgcttagggtttagggtgtaggccttaggstttagggkttattggttagggtttggggtttaggatttagggtttggggtttagcgtttaggggtttggggtttagtgtttagggtttaggatttagggtttatggtytagggcttagggttttgggttaggggttatatttagggcttagggtttwgggtgtaggtttttgtctttacagtttagggtttaggktttagggttagggtttatgtttatgtttttaactaacgaattcattgaacccsrcaaataagtaatgtacagaaaccaaaatgttattaactaac

SEQ ID NO: 417 - DNA, 401 bp, Artificial Sequence
  Consensus Reference Sequence
aagcctaggtttagggtttagtgtttagggkttrgggtttaggggttagggtttgtggtttagtgcttagggtttagggtgtaggccttaggstttagggkttattggttagggtttggggtttaggatttagggtttggggtttagcgtttaggggtttggggtttagtgtttagggtttakgatttagggtttatggtctagggcttagggttttgggttaggggttatatttagggcttagggtttwgggtgtaggtttttgtctttacagtttagggtttaggktttagggttagggtttatgtttatgtttttaactaacgaattcattgaacccsrcaaataagtaatgtacagaaaccaaaatgttattaactaacgaattcattgaaccccac

SEQ ID NO: 418 - DNA, 401 bp, Artificial Sequence
  Consensus Reference Sequence
ggtttgtggtttagtgcttagggtttagggtgtaggccttaggstttagggkttattggttagggtttggggtttaggatttagggtttggggtttagcgtttaggggtttggggtttagtgtttagggtttakgatttagggtttatggtytagggcttagggttttgggttaggggttatatttagggcttagggtttagggtgtaggtttttgtctttacagtttagggtttaggktttagggttagggtttatgtttatgtttttaactaacgaattcattgaacccsrcaaataagtaatgtacagaaaccaaaatgttattaactaacgaattcattgaaccccacaaattmaatacattgaacadaacttaaacwaatacaagtcactcgacta

SEQ ID NO: 419 - DNA, 401 bp, Artificial Sequence
  Consensus Reference Sequence
tatttagggcttagggtttwgggtgtaggtttttgtctttacagtttagggtttaggktttagggttagggtttatgtttatgtttttaactaacgaattcattgaacccsrcaaataagtaatgtacagaaaccaaaatgttattaactaacgaattcattgaaccccacaaattmaatacattgaacadaacttaaacaaatacaagtcactcgactaatatacattaatcaatgatttgaacaacttccatgctcagattgcattggacagcgacgcctgttatgaccttcggctccacatctactacattttgccggtgctcagatggttcgacccaatccatctcattccttatccttgtkgattttggcckacctttcgcacgaattgtagttgg

SEQ ID NO: 420 - DNA, 401 bp, Artificial Sequence
  Consensus Reference Sequence
ccccacaaattmaatacattgaacadaacttaaacwaatacaagtcactcgactaatatacattaatcaatgatttgaacaacttccatgctcagattgcattggacagcgacgcctgttatgaccttcggctccacatctactacattttgccggtgctcagatggttcgacccaatccatctcattccttatccttgtggattttggcckacctttcgcacgaattgtagttgggtcagggataagtgkccatgcgtcatyagaaggagraatagcygyttcattcccaagaggccacyattgtgcggwgtaagcttttaagatgtgctcatttgtrtaaamaacatctatatattggtagtagttcatgctcacrtaaccacaagctgcaataatgtg

SEQ ID NO: 421 - DNA, 401 bp, Artificial Sequence
  Consensus Reference Sequence
caagctgcaataatgtgtgaacatggatartgaarcgcakaataccttccgcattgataatgawgatcattcaagttaactgcccacttttgtccgccacgttgtgttatagggttgaagctctcctctacttcaawccttgtggagtggatatcatacacgcgaacgatgtgcgtacaagcttgttcttgatttttcctcagttctttaacaagctttraacaatatacttgtccttcatataactgcctttgggcttggcggccacgctcaacaaagtactttcgacacctactgtacgttgatttgaccaatgttgttatgrgaatgttgcgacaatcctttaaaaccttattgatacattctgagaagttggttgtcatgtggccatatcgacgtct

SEQ ID NO: 422 - DNA, 401 bp, Artificial Sequence
  Consensus Reference Sequence
aacatggatartgaarcgcakaataccttccgcattgataatgawgatcattcaagttaactgcccacttttgtccgccacgttgtgttatagggttgaagctctcctctacttcaawccttgtggagtggatatcatacacgcgaacgatgtgcgtacaagcttgttcttgatttttcctyagttctttaacaagctttaaacaatatacttgtccttcatataactgcctttgggcttggcggccacgctcaacaaagtactttcgacacctactgtacgttgatttgaccaatgttgttatgrgaatgttgcgacaatcctttaaaaccttattgatacattctgagaagttggttgtcatgtggccatatcgacgtctgttagctctttggcaagtg

SEQ ID NO: 423 - DNA, 401 bp, Artificial Sequence
  Consensus Reference Sequence
cctctacttcaawccttgtggagtggatatcatacacgcgaacgatgtgcgtacaagcttgttcttgatttttcctyagttctttaacaagctttraacaatatacttgtccttcatataactgcctttgggcttggcggccacgctcaacaaagtactttcgacacctactgtacgttgatttgaccaatgttgttatgagaatgttgcgacaatcctttaaaaccttattgatacattctgagaagttggttgtcatgtggccatatcgacgtctgttagctctttggcaagtgtaccaaatygctcgtagtaataatttctyggtaagccgagtgtygtaccacagggattttgttgcacttatgtgaagtacttttcagtttgcaaattgtaaattt

SEQ ID NO: 424 - DNA, 401 bp, Artificial Sequence
  Consensus Reference Sequence
tgatgcctcatgatgacaagcctaccttaattacctatcttccaaatgccctttgcaaagactcgataactaagatgcattaagattgaattctagatgtttgctaaagcacgggcatcgggtcaatgctaaccctatgatttatttcttttattgttctattaagcgttaccctctcycgagtggactaacccttaaaacagattcacgtattcattccttacccctaattaggctttaccctatcccgagtrgactaaagactaacagaaaataaagtctgagatacaaaataaataagaaagaaaagcagataaaagaacctagaaggaaaccctctaaatgataacccgatgatttcttccttttttgttctattaagcgttaccctctcccgagtg

SEQ ID NO: 425 - DNA, 401 bp, Artificial Sequence
  Consensus Reference Sequence
ggaaatcctctttttattgataactcttgaaatgctccatacatcattggctatttaggcctgccaggccctagctaggggtttagtcactcatagtcatgagggytttacaatgagatggggggggkgaaagaaaggtaataagaatataagaaaagggaaggaaaaggagagaactgagtgccaaaagtctgaaaactaagctytgaggaagtgtgttcattttcctaggctgaccctcttatttataggtgcaaaattgggctttgggccttcgtagtctcgctgagcatgaagcctcacgctcagcaccacctcgcgctcaacgcgtgtcgtgcgcttagcgtcttgccttmttgcrtgctgggcacgtcttrtgccttgctggacttgagcttctt

SEQ ID NO: 426 - DNA, 401 bp, Artificial Sequence
  Consensus Reference Sequence
ctgagtgccaaaagtctgaaaactragctytgaggaagtgtgttcattttcctaggctgaccctcttatttataggtgcaaaattgggctttgggccttcgtagtctcgctgagcatgaagcctcacgctcagcaccacctcgcgctcaacgcgtgtcgtgcgcttagcgtcttgccttmttgcrtgctgggcacgtcttatgccttgctggacttgagcttcttctgattttcttctttttttctttatttatgctcctttttgcttgttgtacctccctttttcacatctgcagtcaaaattcaaaattaattaaatctttccaaattaaagcataaataactgctaaataattaattctaagttaatytcagaccgattttccactattaattcacta

SEQ ID NO: 427 - DNA, 401 bp, Artificial Sequence
  Consensus Reference Sequence
agcatgcattccaaaaatttaagttcttgccaagacctatttcccacttagccccttttgccttcwgcactttccactgacacctctctttttcatttttdccctttttcttcttcttatttatttcttttcttttcttttctttttttttttaaattttaataataayaataataataataataataatgggctcataactatttagaggtgttctagtgtgtgctattaccttgkctactttacccatttgttcaaaatcccccaaattaaggccttattagcattcgaaaccctactgctctcttagaatcctacacaaggycaggaatatcaaatttttttttkgcttagggttctactcaaaataaatcattataattctttggctcaatatgggt

SEQ ID NO: 428 - DNA, 401 bp, Artificial Sequence
  Consensus Reference Sequence
ctatttcccacttagccccttttgccttcwgcactttccactgacacctctctttttcatttttdccctttttcttcttcttatttatttcttttcttttcttttctttttttttttaaattttaataataayaataataataataataataatgggctcataaytatttagaggtgttctagtgtgtgctattaccttggctactttacccatttgttcaaaatcccccaaattaaggccttattagcattcgaaaccctactgctctcttagaatcctacacaaggycaggaatatcaaatttttttttkgcttagggttctactcaaaataaatcattataattctttggctcaatatgggtgcaagggataaaattatgttgggttggctttttggt

SEQ ID NO: 429 - DNA, 401 bp, Artificial Sequence
  Consensus Reference Sequence
cgcctcccaaatctgcccatgggccccaatcagtgccagctaagtcaaccatgaggtcctcatcaactgcaggatcctccgtagcggcggctctagaaggcccttcccccctgtcrgtggagggctggtctcctrgccaggygacctgctgacgataggcctccggagtcgtgagcgacgaatccatctgcaagtggaggaacaagcgatgcaggtcctgaawgatgatctgctgtccctggtacaagtacctgagcatttgtccctgcatgtctgaaggtgcggcagttgatggaagyggaggctgtggtcgcwaggaggaaggttgagaagtagggggtgcctcagatgtggatgctggtgctytggtgcgagtccggygggcccctggaaatgtaatg

SEQ ID NO: 430 - DNA, 401 bp, Artificial Sequence
  Consensus Reference Sequence
ggcccttcccccctgtcrgtggagggctggtctcctrgccaggygacctgctgacgataggcctccggagtcgtgagcgacgaatccatctgcaagtggaggracaagcgatgcaggtcctgaawgatgatctgctgtccctggtacaagtacctgagcatttgtccctgcatgtctgaaggtgcggcagttgatggaagcggaggctgtggtcgcwaggaggaaggttgagaagtagggggtgcctcagatgtggatgctggtgctytggtgcgagtccggygggcccctggaaatgtaatggatggatcggcggagttccaaaaattcttcttcacgtatgcaaggttgatcgtagggctgagtgactcaaagatyagggtatcagaaaccaccccytg

SEQ ID NO: 431 - DNA, 401 bp, Artificial Sequence
  Consensus Reference Sequence
crgtggagggctggtctcctrgccaggygacctgctgacgataggcctccggagtcgtgagcgacgaatccatctgcaagtggaggracaagcgatgcaggtcctgaawgatgatctgctgtccctggtacaagtacctgagcatttgtccctgcatgtctgaaggtgcggcagttgatggaagyggaggctgtggtcgcaaggaggaaggttgagaagtagggggtgcctcagatgtggatgctggtgctytggtgcgagtccggygggcccctggaaatgtaatggatggatcggcggagttccaaaaattcttcttcacgtatgcaaggttgatcgtagggctgagtgactcaaagatyagggtatcagaaaccaccccytgaatgtcacacaacgtt

SEQ ID NO: 432 - DNA, 401 bp, Artificial Sequence
  Consensus Reference Sequence
gaaggtgcggcagttgatggaagyggaggctgtggtcgcwaggaggaaggttgagaagtagggggtgcctcagatgtggatgctggtgctytggtgcgagtccggygggcccctggaaatgtaatggatggatcggcggagttccaaaaattcttcttcacgtatgcaaggttgatcgtagggctgagtgactcaaagatcagggtatcagaaaccaccccytgaatgtcacacaacgttgtgaacaacgccgggaacccaagccgcgaggtactggactgggcaatctgactgatctgctgagatataaagytgcccacgtccatatccatccatctcactaagtcgtagatcaagcgtgccctgtcaagattaacatcagatgtgtgagaagtgggtgc

SEQ ID NO: 433 - DNA, 401 bp, Artificial Sequence
  Consensus Reference Sequence
ctggaaatgtaatggatggatcggcggagttccaaaaattcttcttcacgtatgcaaggttgatcgtagggctgagtgactcaaagatyagggtatcagaaaccaccccytgaatgtcacacaacgttgtgaacaacgccgggaacccaagccgcgaggtactggactgggcaatctgactgatctgctgagatataaagctgcccacgtccatatccatccatctcactaagtcgtagatcaagcgtgccctgtcaagattaacatcagatgtgtgagaagtgggtgcaagatcataataagaraggacactccatgtctgagsrrgtgtcgtcatgtccttcctcaacagcttccaggggagaccatcgacgtttagaatgaaatgcccccctggagta

SEQ ID NO: 434 - DNA, 401 bp, Artificial Sequence
  Consensus Reference Sequence
gttgtgaacaacgccgggaacccaagccgcgaggtactggactgggcaatctgactgatctgctgagatataaagytgcccacgtccatatccatccatctcactaagtcgtagatcaagcgtgccctgtcaagattaacatcagatgtgtgagaagtgggtgcaagatcataataagaraggacactccatgtctgagsargtgtcgtcatgtccttcctcaacagcttccaggggagaccatcgacgtttagaatgaaatgcccccctggagtacatattgtggcggcgatggtgtcaggatcgggatgagtgctgggatatctggtgtaggctgggtactcctcaccatcctcttggatgactggggtgtcgaggaattcgttaatcgtgtcagcgtt

SEQ ID NO: 435 - DNA, 401 bp, Artificial Sequence
  Consensus Reference Sequence
gggggtgcagaaagtaggtagaaggggtgtagagagtagaagtgggggtgcaaagagtaaagcgcgagggctgatgggccctaagactagccccgcgcttggcgccccctgcacactgttgctggcacgcgcttagcgccaagggtgggcgcttagcgcgttcgctgatctttaagagcgcgcttagygcgcagcgccgcacttaacgggctcgtccttatggcctcyagtccgtcagcattcgctaagccttgagcaaggcttagcgcaatgagacctgtgtattcatacaaacagcaatgcatagaaaatttcgttaccttcgttagtgactattttgcgtgagagattcagtaattaagcaagggtgatgaaaagaggtgaaagggggtgagatttgc

SEQ ID NO: 436 - DNA, 401 bp, Artificial Sequence
  Consensus Reference Sequence
tgtagagagtagaagtgggggtgcaaagagtaaagcgcgagggctgatgggccctaagactagccccgcgcttggcgccccctgcacactgttgctggcacgcgcttagcgccaagggtgggcgcttagcgcgttcgctgatctttaagagcgcgcttagygcgcagcgccgcrcttaacgggctcgtccttatggcctccagtccgtcagcattcgctaagccttgagcaaggcttagcgcaatgagacctgtgtattcatacaaacagcaatgcatagaaaatttcgttaccttcgttagtgactattttgcgtgagagattcagtaattaagcaagggtgatgaaaagaggtgaaagggggtgagatttgcgcagaaaggaaggaagaatgacgaaat

SEQ ID NO: 437 - DNA, 401 bp, Artificial Sequence
  Consensus Reference Sequence
cgtgagagattcagtaattaagcaagggtgatgaaaagaggtgaaagggggtgagatttgcgcagaaaggaaggaagaatgacgaaatgaggcgcctacgatttaataccgttgaagaggcaactgaggagttgggcagtttcaaaaactgcccaagaatttatggtactcgcgcttagcgcacatgtggccgctaagcgcgccaagggaagcgtcccttggttgcccctcagattcaaaattcaaatcttggaaaacatacctgggtgcttagcgcgtagtcgcgcgctaagcgcgtggcttcgtgyagcccacttyaatttgctattggtacccctccttttgctgtcttcacctgttgggcctttgcttttcgtaccccctgtttgctgtttgcacct

SEQ ID NO: 438 - DNA, 401 bp, Artificial Sequence
  Consensus Reference Sequence
accgttgaagaggcaactgaggagttgggcagtttcaaaaactgcccaagaatttatggtactcgcgcttagcgcacatgtggccgctaagcgygccaagggaagcgtcccttggttgcccctcagattcaaaattcaaatcttggaaaacatacctgggtgcttagcgcgtagtcgcgcgctaagcgcgtggcttcgtgcagcccacttyaatttgctattggtacccctccttttgctgtcttcacctgttgggcctttgcttttcgtaccccctgtttgctgtttgcacctgtttgcycccccccccccttttttaaaacaaaaaaatagaaaataaaaaatgcaaaatataataaagacaraatataaatacctacgattaccttaaataaatatgt

SEQ ID NO: 439 - DNA, 401 bp, Artificial Sequence
  Consensus Reference Sequence
aggcaactgaggagttgggcagtttcaaaaactgcccaagaatttatggtactcgcgcttagcgcacatgtggccgctaagcgygccaagggaagcgtcccttggttgcccctcagattcaaaattcaaatcttggaaaacatacctgggtgcttagcgcgtagtcgcgcgctaagcgcgtggcttcgtgyagcccacttcaatttgctattggtacccctccttttgctgtcttcacctgttgggcctttgcttttcgtaccccctgtttgctgtttgcacctgtttgcycccccccccccttttttaaaacaaaaaaatagaaaataaaaaatgcaaaatataataaagacaraatataaatacctacgattaccttaaataaatatgttgggttgcct

SEQ ID NO: 440 - DNA, 401 bp, Artificial Sequence
  Consensus Reference Sequence
tgcttttcgtaccccctgtttgctgtttgcacctgtttgcycccccccccccttttttaaaacaaaaaaatagaaaataaaaaatgcaaaatataataaagacaraatataaatacctacgattaccttaaataaatatgttgggttgcctcccaaccarcgcttagtttaatgtctttagctagacatagggcttctttaaaggatcttttaagtgcatgacggtcgtcaacttctctagttgtcctccatwktagatctttaagcgytgtcygttgacgatccatttcttctcataattttctactcgagggtccaccaatkctaccrctccrtgaggtctgatttctttartaatgaacgrtcctraccactttgacttcagctttcytgggaatagt

SEQ ID NO: 441 - DNA, 401 bp, Artificial Sequence
  Consensus Reference Sequence
ttttttaaaacaaaaaaatagaaaataaaaaatgcaaaatataataaagacaraatataaatacctacgattaccttaaataaatatgttgggttgcctcccaaccarcgcttagtttaatgtctttagctagacatagggcttctttmaaggatcttttaagtgcatgacggtcgtcaacttctctagttgtcctccataktagatctttaagcgytgtcygttgacgatccatttcttctcataattttctactcgagggtccaccaatkctaccrctccrtgaggtctgatttctttartaatgaacgrtcctraccactttgacttcagctttcytgggaatagtctcaachtggarttgaagagtagtacctgctgccctggctggaattctttct

SEQ ID NO: 442 - DNA, 401 bp, Artificial Sequence
  Consensus Reference Sequence
tttttaaaacaaaaaaatagaaaataaaaaatgcaaaatataataaagacaraatataaatacctacgattaccttaaataaatatgttgggttgcctcccaaccarcgcttagtttaatgtctttagctagacatagggcttctttmaaggatcttttaagtgcatgacggtcgtcaacttctctagttgtcctccatwgtagatctttaagcgytgtcygttgacgatccatttcttctcataattttctactcgagggtccaccaatkctaccrctccrtgaggtctgatttctttartaatgaacgrtcctraccactttgacttcagctttcytgggaatagtctcaachtggarttgaagagtagtacctgctgccctggctggaattctttctt

SEQ ID NO: 443 - DNA, 401 bp, Artificial Sequence
  Consensus Reference Sequence
ccatgaagtctatgccccagcagtcgaagatctcaacttccattacattttgtaatggcatttcattccttcgtgagattccccatgtcctttggcatctatcgcaatatygcacaaactcgtgggcatctttaaaaatggagggccagaaaaaacccgattgtakcacttttgccgccrttctatccccattgtgatgaccaccatagagtgaactgtggcagtgccaaagaatatttcacgcttcttccttcttaacaaattaccagcccctaccttgaataaatgaggatcatcctagacatagaagtgtgaatcatgcaagaatttcttcttctgattccaatcaaattcttctggaatgatcccggtggytttatagttggccatgttcgcaaacc

SEQ ID NO: 444 - DNA, 401 bp, Artificial Sequence
  Consensus Reference Sequence
aactgtggcagtgccaaagaatatttcacgcttcttccttcttaacaaattaccagcccctaccttgaataaatgaggatcatcctagacatagaagtgtgaatcatgcaagaatttcttcttctgattccaatcaaattcttctggaatgatcccggtggytttatagttggccatgttcgcaaaccaaggtcgagtgtcggcctgtaagaggaattcgtcakggaattcgccttttacctctgsttcctccttggtgatctcctcattcttcaatctggacaaatggtcagccactacgttttcggatcctctcttatcctkgatggtgatatcaaattcttgtagcaacaagacccatctaattaatctyggcttcgaatccgccttagctagcaaat

SEQ ID NO: 445 - DNA, 401 bp, Artificial Sequence
  Consensus Reference Sequence
tcagccactacgttttcggatcctctcttatcctkgatggtgatatcaaattcttgtagcaacaagacccatctaattaatctyggcttcgaatccgccttagctagcaaatgcttgatggcrrcatggtcagtgaagatgatgacccttgatcctatcaagtaagaccgaaacttttctaagacaaaaacaatggccaacatctctttctctgtagtggcgtaatttaattgygcctcgtttaggacyttrctggcataatatatggcgtgaaaaaccttgtcatgcctttgtccyagaactgcacctactdcataatcgctagcatcacacatcaattcaaaatcyttgctccaatctggggcaatcrttacyggtgcmgtggtgagcctatgcttcag

SEQ ID NO: 446 - DNA, 401 bp, Artificial Sequence
  Consensus Reference Sequence
gtgggtattaggtyattcatttcattcttcacaactgtcattccacctttcttggggtccacttgtaccggactgacccaaccgctatcagagatagggtatacgagtccagcctctaacaacttaagcacttccttccttacttcttctttcatagttggattyagacgtctttgaggttgtcgaataggcttgtaatcatcctccatcattattttatgcatgcagtatgaaggactgattcccttcaagtcagatatatgccatccgattgcttccttatgcctcctcaggatgtccaccatcttgttctcttcgtcctrtgttagtgcattactaattactayaggcttggtgtcaccctccaggaacacatactttaaatgattaggcaatacctt

SEQ ID NO: 447 - DNA, 401 bp, Artificial Sequence
  Consensus Reference Sequence
atgcagtatgaaggactgattcccttcaagtcagatatatgccatccgattgcttccttatgcctcctcaggatgtccaccatcttgttctcttcgtcctrtgttagtgcattactaattactayaggcttggtgtcaccctccaggaacacatactttaaatgattaggcaatacctttaattcgaccttctttttttccggcagagcctcattstctaatatctcaaaacaggcttccttctcagggatgacttcttgccgatccaagtcttccaagaaagcctttagatcctcttcttcttcactggtgagacagtccatcttatttatcattsctttctccagtgaagtgtatggtggttccagaatattgacattatcttccttgtcaatctcttc

SEQ ID NO: 448 - DNA, 401 bp, Artificial Sequence
  Consensus Reference Sequence
ctgattcccttcaagtcagatatatgccatccgattgcttccttatgcctcctcaggatgtccaccatcttgttctcttcgtcctrtgttagtgcattactaattactayaggcttggtgtcaccctccaggaacacatactttaaatgattaggcaatacctttaattcgaccttctttttttcsggcagagcctcattctctaatatctcaaaacaggcttccttctcagggatgacttcttgccgatccaagtcttccaagaaagcctttagatcctcttcttcttcactggtgagacagtccatcttatttatcattsctttctccagtgaagtgtatggtggttccagaatattgacattatcttccttgtcaatctcttctatcttgaagcactt

SEQ ID NO: 449 - DNA, 401 bp, Artificial Sequence
  Consensus Reference Sequence
  misc_feature 263: n = A,T,C or G
tatttatcattsctttctccagtgaagtgtatggtggttccagaatattgacattatcttccttgtcaatctcttctatcttgaagcacttccaaccttcccgcrgatacttcattgctttaaagaggtcgaaagttatcttctrattttcaatactcagttccaagcttccgttccccatatctgcgacacagttggcaatcaacatgaagggtctgcctaagataaggggaatctctgtgtcttcattgatrtccatgatnacaaagtccamtggaaaagtgaagtggygaaccttgactaggacatcttctaccaccccgtatggtctcgtaattgagcggtctgccaattgaagtgtcatcttagtggratcaattttyagattcccaatttgtcta

SEQ ID NO: 450 - DNA, 401 bp, Artificial Sequence
  Consensus Reference Sequence
tagccctttcatgggctagctgacccagttgtgtctccaggtttctgatagttgcatctgtgctctttgggtgtgatctcgtctcctggatgaatgcctttgtctcctgagtgcttgcccttgtttcttggatgaatgcctttgtctcytgagtgcttgcccttgtttcttggatgaaacttaagagcatttcctttatactgagagacggcttctcttgctgactcagaccttgactagggtgctggtacgatggttgaggcctaggctccttgtactgatttccttgatttctccagtcggagccttggttaaagtttcttccctggttaaatgytggtggtccgttattgtatccaaaygggtttccttggttgtagccttggaaaccgtggcgatta

SEQ ID NO: 451 - DNA, 401 bp, Artificial Sequence
  Consensus Reference Sequence
tgcctttgtctcytgagtgcttgcccttgtttcttggatgaaacttaagagcatttcctttatastgagagacggcttctcttgctgactcagaccttgactagggtgctggtacgatggttgaggcctaggctccttgtactgatttccttgatttctccagtcggagccttggttaaagtttcttccctggttaaatgctggtggtccgttattgtatccaaaygggtttccttggttgtagccttggaaaccgtggcgattaggattgcccatgtaawttatttcttragagggmtcatgttggrttgtgcattgtccagrctcatgtgtccctccacatgtgggacatccctctacttrcaaaacaggrgaatgagaartattcaytgcttryartt

SEQ ID NO: 452 - DNA, 401 bp, Artificial Sequence
  Consensus Reference Sequence
  misc_feature 398: n = A,T,C or G
tttttyakaaatttctcwacaacttcttcccaagtcctaaarktgttgcccttaaaagaatgcaaccatctttttgcctctcyygctaaygagaaagaaaagaggttgaggcgtaccgcttgtgctggaactcyygctatcttaaycgtgttgcatatttctataaatraggctagatgcgtatagggatcctcacttggaagaccmtggaagaggttcccctgaatcagctgaatgagagaatgagggtaygaaatattargcgcttgaacctccggcggtgtgatacttgtgaagaattcwggagtagtagtatgrgagaartcytctaatgtaaccctaygtrctggttctycgtccatttgarcgtgatttggagaaagaggaggtgaagtatntat

SEQ ID NO: 453 - DNA, 401 bp, Artificial Sequence
  Consensus Reference Sequence
  misc_feature 3: n = A,T,C or G
atntatgtcttgctccctttgtcttcttgyrgcgttgttacgccracadgtagcttcgatttctaagtctatrggaacgatartagatttayctcgcataaaaacacarggttctacccgtgtaatttatggaraaggaamgaatggggaaagaggagtggtgatagaaagaatggccaagagggaaacaaattacaaaccggtagtatggcacttaaatgcgaaaacaaaatccccggcaacggcgccaaaaacttgttagctctttggcaagtgtaccaaatcgctcrtagtaataatttctcggtaagccgagtgtcrtaccacagggattttgttgcacttatgtaaagtacttttcagtttgcaaattgtaaatttagtgtataaaattaaaggca

SEQ ID NO: 454 - DNA, 401 bp, Artificial Sequence
  Consensus Reference Sequence
tayctcgcataaaaacacarggttctacccgtgtaatttatggaraaggaamgaatggggaaagaggagtggtgatagaaagaatggccaagagggaaacaaattacaaacyggtagtatggcacttaaatgcgaaaacaaaatccccggcaacggcgccaaaaacttgttagctctttggcaagtgtaccaaatcgctcatagtaataatttctcggtaagccgagtgtcrtaccacagggattttgttgcacttatgtaaagtacttttcagtttgcaaattgtaaatttagtgtataaaattaaaggcaatttaaatctacgtagctacttctaaactaaagaaaactaaagcaataaataaagaataaagtctataaaatattactaaaatctaata

SEQ ID NO: 455 - DNA, 401 bp, Artificial Sequence
  Consensus Reference Sequence
  misc_feature 162: n = A,T,C or G
ggataaataagaaagaacggtaaataaaagaacctggaaggaaatcctctttttattgataactcttgaaatgctcyatacatmattgrytttttaggcctgycaggycctarctaggggtttagccactcatagtcatgagggctttacaatgagaagggnggggggggtgaaagaaaggtaataagaatataagaaaaaggaaggaaatggagagaactgagtgccaaaagtctaaaaacagagctctgaggaagtgtgttcgttttcctaggctaaccttattatttataggtgcaaaattgggctttgggtcttcgtagtcccgctgagcgcgaagcctcgcgctcagcgccacctcgcgctcagcgcgtgtcgtgcgcttagcgccttgccttctt

SEQ ID NO: 456 - DNA, 401 bp, Artificial Sequence
  Consensus Reference Sequence
ctaggctaaccttattatttataggtgcaaaattgggctttgggtcttcgtagtcccgctgagcgcgaagcctcgcgctcagcgccacctcgcgctcagcgcgtgtcgtgcgcttagcgccttgccttcttgcgcgctgggcgcgtcctgcgcttagcgccttgctgracttgrgcttcttctgattttcttctttttttcctttatttytgctcctttttgcttgttgtacctccctttttcacatctgmaatcaaaattcaaaattaattaaatctttccaaattaaagcataaataactgctaaataattaattctaagttaatttcagaccgattttycactattaattcactattatttagcagttatcaacgtccttctctatcataagccatca

SEQ ID NO: 457 - DNA, 401 bp, Artificial Sequence
  Consensus Reference Sequence
cgcgtcctgcgcttagcgccttgctgracttgrgcttcttctgattttcttctttttttyctttatttytgctcctttttgcttgttgtacctccctttttcacatctgmaatcaaaattcaaaattaattaaatctttccaaattaaagcataaataactgctaaataattaattctaagttaatttcagaccgattttccactattaattcactattatttagcagttatcaacgtccttctctatcataagccatcatccatttttcctttgaaatgcgatcaatycatgttgctatggctggactcagttgacgaaatttttctaaattttgataaaaaaatgtgcttgcaaggagtgtaggctgcataaaattagttatgaataactattttaagy

SEQ ID NO: 458 - DNA, 401 bp, Artificial Sequence
  Consensus Reference Sequence
tttgtatgacaccttgtaygcaaattsactgttaatcctctcttgaatcaahgaaayttttattgatggatcttctctgrtcatgymtgtcaatagaataacaaaatttaaatgacaattaaggctaaacaataacataatatgaacataaaatacgtacctactacacaagtgacaattaaatvtgaatcaagcttctyatgatcttgggtcatggtcatattgagacatgtgtgtggtccaccccattsagtgactttccatgaatcagtttttttagatagaattdccctcatatagaaagggmaaggacaatctgcatttttattcaagcaacaaacvacatacttgtcccatttgctttcaaccactttgaaactttgatgmaycttcatarcata

SEQ ID NO: 459 - DNA, 401 bp, Artificial Sequence
  Consensus Reference Sequence
gtctgtatcaratataccgtcaacactgtcatcttcgtctaaaraytyttcaacgtatgagttagacacaagataatcatcatcatcatcwtygtcaacatgtaaattgctcatatttgttggcrrttgtrtctcatcattagataaataatttccacatgatgtaagsgaatttgmagaatgaaacattgaaccactrgccacatccttttctatgtacaattctagaactgacatttgttsttgttgtttaaaactttycagcatcgtttcaacgtcttygtcatcacaaatttrcaaggcaatatattttcctgacactaaaaatctacaactratagcagaaataatttcattattttgtaactttaccttrtctccaatttttttcttcaaagcay

SEQ ID NO: 460 - DNA, 401 bp, Artificial Sequence
  Consensus Reference Sequence
catataaaatataaaactaatttaattaaaaaattattaaaaactatacattcaaactgctctaaaaaattacttaaaaatattttataatacaaattatttgactgaaaattaccaacctgattcagaaatttaagcctcaacaaacaaatttcaaaccttatgtgcacaaatttaaatctcaagaaacgttcacagtgattgaaaactgaaatgtaattttgaacacatagcaacacttctgagaactaaaatgtagttttgaacacacaacaacactgaggtaatttttgagtatataagggccctaaatcgccatcttcaatggctatttccttcgccctaaatcgccaatggcaattgcaacttgcccttaactcgtcaatggcagtwgcaacttg

SEQ ID NO: 461 - DNA, 401 bp, Artificial Sequence
  Consensus Reference Sequence
tcacagtgwttgaaaactgaaatgtaattttgaacacatagcaacacttctgagaactaaaatgtagttttgaacacacaacaacactgaggtaatttttgagtatataagggccctaaatcgccatcttcaatggctatttccttcgccctaaatcgccaatggcaattgcaacttgcccttaactcgtcaatggcagtagcaacttgccttttggcctgtcatctgaaaaaagcaacctgccacctgaaaaagcaagtgccacaggcctacgaacacagcacctggaactygccagtttgactggcggttcccactggcacgtatatcgccattagcactggcgatttcttcacggagaccaaactcaccagttccactggcggtttgggtgctacatg

SEQ ID NO: 462 - DNA, 401 bp, Artificial Sequence
  Consensus Reference Sequence
taatttttgagtatataagggccctaaatcgccatcttcaatggctatttccttcgccctaaatcgccaatggcaattgcaacttgcccttaactcgtcaatggcagtwgcaacttgccttttggcctgtcatctgaaaaaagcaacctgccacctgaaaaagcaagtgccacaggcctacgaacacagcacctggaactcgccagtttgactggcggttcccactggcacgtatatcgccattagcactggcgatttcttcacggagaccaaactcaccagttccactggcggtttgggtgctacatgcatgcgttttacgtccaaaagagtcccctcgtggaaatacttcaaaaacgaccccatctggggaaaaagtttataaaaggaccccaaatggg

SEQ ID NO: 463 - DNA, 401 bp, Artificial Sequence
  Consensus Reference Sequence
tataaaaggaccccaaatggggaaatttgcctaacttagagatagaatgcaaggcttgtattattcactgtcctatatatttatttaccaaacattggtggaaattttaaggagtgmcaagttcatattagcttttaaccatcaaagaaaaggctggcactaacaaccagttatttgtcaataggaaaggaagcttgggcccaattgaaggatattgtggaaaattagtgtctctttgatttcagaagctttactcttytttttttttcaatacttacaaaactatcatcttatttttttacctcatgtcatgatttgaagaatgtgttttgctacaaagtastgatactttaatttgcttcatgcatctatatmtrataccaatatattgatacatttca

SEQ ID NO: 464 - DNA, 401 bp, Artificial Sequence
  Consensus Reference Sequence
ttgtcaataggaaaggaagcttgggcycaattgaaggatattgtggaaaattagtgtctctttgatttcagaagctttactcttytttttttttcaatacttacaaaactatcatcttatttttttacctcatgtcatgatttgaagaatgtgttttgctacaaagtastgatactttaatttgcttcatgcatctatatatrataccaatatattgatacatttcattggtacatatatgtgaagtgaccaattctttaaaaaaattatgataatcaaatatadtgacatgtaacawagaagtaagtataatatagaaatataaaawdtattrtttcttgatgaaccaaatatgaaaattgttttgtttatagataatttcaaraaagaaatgagattga

SEQ ID NO: 465 - DNA, 401 bp, Artificial Sequence
  Consensus Reference Sequence
catyatccttgcctccaaygcttcaycactttgggaaacattctccaasttccyaatttcaagctgaccatraagatttgaaagtcctcccaattctttgatcccattctcttkgtgcttrcccacaacaaagaaatccagatgttgtagrtgatttaatttacwmattyctctcggcatctcttytataggagtttcacatatctcaagatgacgcaagttaacaacattgcrcatgtcactaggcaacttagtcagytttctgcaacwacacaacttcaaagtttgcagattgtataaattacacaatgactttggcagtgtttctacacttgaatgagaragatctaaatagcgcaratgratcaatttacctattgaatcaggcaaagaatccagac

SEQ ID NO: 466 - DNA, 401 bp, Artificial Sequence
  Consensus Reference Sequence
cactgcrctctctttcaaatyaagaytctccttgagttttaaatgagactcaagcgtgacaactatgtcttccaacttactaacgatcttcctattggaaaagcgagaaatcaagtctcttaccttgttttgggtggcagctttggtgaaaacatggtcgagtaagtcatcggcttcatagacagcatctttgaragcatggagccagtgtttgacattggtgtttgtgrtctgtttcttctcggcatcatcaagcacagctccaaccactctgagartggtctccaacttttgaagcaacttcttgcyaagcttctttccamggatcaagtsaacaaactcaggtgaagccagcctgtcgaaaagcacatcaagraaagcagagagaaaggcaccaccka

SEQ ID NO: 467 - DNA, 401 bp, Artificial Sequence
  Consensus Reference Sequence
atccaaaagtkatgtaaagatgctcaayttagaatttytttctaaagttaaaatttaaaatcaattwttcaatgtgaaagtaaatagtcaaatatttacwtaaattcgtgttagtttatatttcaacctgattttttataatcaaacatagatcattaaagttgtcatagagatatgttattgtataaagatctaatactcaatcatgattttataaaaagttaaaataattgatagtaatttatakttttttaatcaagtggtaaaagatttaaatctttattaattcttatatatagaataaattttgttaggaggaaaataaaaaatgagattaaaaaattattaagacaawaaaaatgttgaacaaatcaaaagagaaaattaaagaaatgacacat

SEQ ID NO: 468 - DNA, 401 bp, Artificial Sequence
  Consensus Reference Sequence
attatttttttcwttttactaccaaacaaaaccttacaggatttttttactccactacacttgctctctcctcattttttccaaaatacacctgcctcaaaatygtttcctaaacaacactccyttttagcttgcagagagaagtcsgggttagggaacccaacttctctttgctcctattattttttaattttaaaaaactattaaattcttttttatattttttaaaaataatttacttgttttttaaattttattttcagataaaaaaataattaaaatttttaatattattattttgttttttaaataatgagaatattttttgtttaattatttattwatagtttgaaaataattaattaataatmttaaaataaatttaaaaaamaaagtgatta

SEQ ID NO: 469 - DNA, 401 bp, Artificial Sequence
  Consensus Reference Sequence
  misc_feature 11: n = A,T,C or G
gtagaaatcantataaatacaatagcatgtaataagcagcacratatgaatgaaattagcaaattactcycatctctgctcttcttcttcctctrgaggttytggtgcctcgaagccagytcttaatttcytgcatttatgttcagttcgtaacaattggtkctctcgtttgtcctcatggcctcmcgcaacctcgacgaagcccttgtccgtcttgacaataccatgcactctatgaccctcaayatggacaagcttckcaaccgccttgctcctgtgccttcctccwccacgcccaaccccacacyagtccctygccactccacctctgttcctrcacaaatccgatatgccycatcaccgtatgaggatcctgtcgrtgccttgttcaaactcactca

SEQ ID NO: 470 - DNA, 401 bp, Artificial Sequence
  Consensus Reference Sequence
ataaaagatttaaattaaaagatggtaaagataaaaaagataagatwagaaaaataaaagataacagaaataaaagattaagataaaaaagataagtgttaacatgctaaaaattttcctttttgatattttctcgatctttttttttaatctatcattttcatatttgcaagccataaataataaaattatcaattcttatyatttaagctaaaaataattgttaaataaatatttttaaagatatttcaatatatttttattataaaaaatagytyacatcatatttaacactctttcccttacaaggaaaataaaacgcgactcatactcacgcagtcacgcgacacaccacagtgacacarcctcggcccaccaccatgycaccacgcaaaatacat

SEQ ID NO: 471 - DNA, 401 bp, Artificial Sequence
  Consensus Reference Sequence
tgaacttaatttgattgtattgtatttttattaaaattraaattcttttaaaactaggcccgtggaccggtccatttgacccgtggggtctgcgaggcaagggcggaccaatttatttggtccgtgtaagaagcggggcggactggtccggtccgctaccaatgcgggcgggccttacgcggggcggggcggcccgcttacccayccctaccgcagacccattgggtcctaatatagagcaacctgacccgaagctagccacactyatatccgaaggacctracccaaaacccacacctgacccagacccaaaacccacacctracccgracccaaaccccacacycgacctggaactggcccaaataagttcgaactccttatcgggtgatttagcaccg

SEQ ID NO: 472 - DNA, 401 bp, Artificial Sequence
  Consensus Reference Sequence
cttaatttgattgtattgtatttttattaaaattraaattcttttaaaactaggcccgtggaccggtccatttgacccgtggggtctgcgaggcaagggcggaccaatttatttggtccgtgtaagaagcggggcggactggtccggtccgctaccaatgcgggcgggccttacgcggggcggggcggcccgcttayccacccctaccgcagacccattgggtcctaatatagagcaacctgacccgaagctagccacactyatatccgaaggacctracccaaaacccacacctgacccagacccaaaacccacacctracccgracccaaaccccacacycgacctggaactggcccaaataagttcgaactccttatcgggtgatttagcaccgagaa

SEQ ID NO: 473 - DNA, 401 bp, Artificial Sequence
  Consensus Reference Sequence
cgtggggtctgcgaggcaagggcggaccaatttatttggtccgtgtaagaagcggggcggactggtccggtccgctaccaatgcgggcgggccttacgcggggcggggcggcccgcttayccayccctaccgcagacccattgggtcctaatatagagcaacctgacccgaagctagccacactyatatccgaaggacctaacccaaaacccacacctgacccagacccaaaacccacacctracccgracccaaaccccacacycgacctggaactggcccaaataagttcgaactccttatcgggtgatttagcaccgagaattttgcaccccgtcrgccttctctccggcaattgtgtggtcctccttgttgatgggggaagtaaccacaacttcctc

SEQ ID NO: 474 - DNA, 401 bp, Artificial Sequence
  Consensus Reference Sequence
cacacycgacctggaactggcccaaataagttcgaactccttatcgggtgatttagcaccgagaattttgcaccccgtcrgccttctctccggcaattgtgtggtcctccttgttgatgggggaagtaaccacaacttcctccagcctcaactagctatctctttgggcttaccttgtcggaccgctccaacaccattacacgtgatgttctttcatcacgggcgcttcgtggaattgcakggtgagaacgccaccactccgggtcttcttccccaacaccagttctgccacctctrtcggcacaaygagggtktttcgcacttccatattgctaggtttcctgaagctcctcctgactcactacccattgacacacctagtgcaattcgtcggaataaac

SEQ ID NO: 475 - DNA, 401 bp, Artificial Sequence
  Consensus Reference Sequence
ctccttgttgatgggggaagtaaccacaacttcctccagcctcaactagctatctctttgggcttaccttgtcggaccgctccaacaccattacrcgtgatgttctttcatcacgggcgcttcgtggaattgcakggtgagaacgccaccactccgggtcttcttccccaacaccagttctgccacctctrtcggcacaacgagggtktttcgcacttccatattgctaggtttcctgaagctcctcctgactcactacccattgacacacctagtgcaattcgtcggaataaaccttgagatcccrgtattgtttttggatccatagtttgaaaaaccaacaccttgaggacaaggtgtttttgatggggcagggagtgatagggaagcgtgatagcata

SEQ ID NO: 476 - DNA, 401 bp, Artificial Sequence
  Consensus Reference Sequence
gcacttccatattgctaggtttcctgaagctcctcctgactcactacccattgacacacctagtgcaattcgtcggaataaaccttgagatcccrgtattgtttttggatccatagtttgaaaaaccaacaccttgaggacaaggtgtttttgatggggcagggagtgatagggaagcgtgatagcatagcagacaaaggaatgtattcaaaagaaatagatgcgaatcaagacatagcaactataggggtgtctacagcaaagaagggtgtaaatcaagcagaaaagraggtgcaagcagcagtcaatacctaaagaaagacctcaaagcctgcttaccttaaggactacgtgtgatcctaaggarygatgttgaatgatctgtgctggaagcatgggag

SEQ ID NO: 477 - DNA, 401 bp, Artificial Sequence
  Consensus Reference Sequence
gatcccrgtattgtttttggatccatagtttgaaaaaccaacaccttgaggacaaggtgtttttgatggggcagggagtgatagggaagcgtgatagcatagcagacaaaggratgtattcaaaagaaatagatgcgaatcaagacatagcaactataggggtgtctacagcaaagaagggtgtaaatcaagcagaaaagaaggtgcaagcagcagtcaatacctaaagaaagacctcaaagcctgcttaccttaaggactacgtgtgatcctaaggarygatgttgaatgatctgtgctggaagcatgggagacaagaaaaatgatttctgatttcctctagcacaaaaggacaaaatcwgttatgtagaaatcagtataaatacaatagcatgtaataa

SEQ ID NO: 478 - DNA, 401 bp, Artificial Sequence
  Consensus Reference Sequence
  misc_feature 229, 337: n = A,T,C or G
aaacagcttctatcttcttccctatcaacaagtatatagcatatataattatgtatgacaattttaagaaaataaasaacactaatataaaatatatagaatggtaaaatacaaaaaaaaaaaaacaaaaaaaacaagatcatayctgcatttcgagwggtatcttatggaatctagattacccaagaacagaaattaaaaacttgaaagaagaaacagagwaaaaagnaaaatatttaagatatgttgtaacccggaatcaaaataaaagtttataaataattcaagcacatatatatacaccaaataataataccttagtaaargcaaaaaaaanataataataccttarcaaattttcctctgaaaacagagagtgcaaccttccasaaggctcgtgt

SEQ ID NO: 479 - DNA, 401 bp, Artificial Sequence
  Consensus Reference Sequence
  misc_feature 104, 212: n = A,T,C or G
caaaaaaaacaagatcatayctgcatttcgagwggtatcttatggaatctagattacccaagaacagaaattaaamacttgaaagaagaaacagagwaaaaagnaaaatatttaagatatgttgtaacccggaatcaaaataaaagtttataaataattcaagcacatatatatacaccaaataataataccttagtaaaagcaaaaaaaanataataataccttarcaaattttcctctgaaaacagagagtgcaaccttccasaaggctcgtgtgtaatgcatgattacwgcagtaaaacaatttccactgttttctcttctatgtkatttagaacaccrcaatgtcatgtaaaaaattgacaagaacccatataacaggtgctcawgygtgtgaacca

SEQ ID NO: 480 - DNA, 401 bp, Artificial Sequence
  Consensus Reference Sequence
aacaaatwaaaaaattactatccataacatctatttcgatgaactatcgcatagctaatctatttgttcggggtcttgaagttaaagcttggaggacaaaacaaagtagtgtacaagtacttggtgctatggcataccgtgctcctcarcatttgtctcrgtgtctccytaagattgttcccaaattgrctgaggtataacatgaagcaaacattatttttcacttctaaattccttttaagctatagattgcattacyttaacccatctcrgtatttgaaggttttsaytgatacacatcytawagtccagtcagctgggcaaatggcccttcaacacgttagtcttgactyacgaactattctatccatttgattcmtgcttgcttctgtgattaatgt

SEQ ID NO: 481 - DNA, 401 bp, Artificial Sequence
  Consensus Reference Sequence
ttgtctcrgtgtctccytaagattgttcccaaattgrctgaggtataayatgaagcaaacattatttttcacttctaaattccttttaagctatagattgcattacyttaacccatctcrgtatttgaaggttttsaytgatacacatcytawagtccagtcagctgggcaaatggcccttcaacacgttagtcttgactcacgaactattctatccatttgattcmtgcttgcttctgtgattaatgtttttaattttcatgttttttccaggtagggaatgtgatagagtccagaaatatctggtcttrtccctactctacttaagtaaattggtgttttcrgtatctagagggaggaataaaagtaattcttttgaaattrtggcataaraaatcrtc

SEQ ID NO: 482 - DNA, 401 bp, Artificial Sequence
  Consensus Reference Sequence
  misc_feature 396: n = A,T,C or G
acccatctcrgtatttgaaggttttsaytgatacacatcytawagtccagtcagctgggcaaatggcccttcaacacgttagtcttgactyacgaactattctatccatttgattcmtgcttgcttctgtgattaatgtttttaattttcatgttttttccaggtagggaatgtgatagagtccagaaatatctggtcttatccctactctacttaagtaaattggtgttttcrgtatctagagggaggaataaaagtaattcttttgaaattrtggcataaraaatcrtcattcaattcmactctactwttatatgttgcatatttattgtaattrtttgatgtatattttcatgaaatttcatycttcaaatcttatctatacaaaaatgttantgtta

SEQ ID NO: 483 - DNA, 401 bp, Artificial Sequence
  Consensus Reference Sequence
ttcagataatatccaaacgattcaactttattttaaatacactartcacttatactcrgtcacttaatcatttggttgcatcaratttartttcactctargcaataacatgttggtcacaagaatatatattacatattaactttgaaaataaaatataataaaatttctaactcaactttttaawtttcttarttttcattctaatartatggtcactcatcaaagcatggcttgggtatatactatatagcgaagatcctccgtcatcttgaggatatatatwtcatgatcataagtggaataagaatgcacatattgcaawgatagaaatttawkaaagacagtgcatctgaaaarcagatggattatcattgatatgcatagtagttggmcaataa

SEQ ID NO: 484 - DNA, 401 bp, Artificial Sequence
  Consensus Reference Sequence
  misc_feature 335: n = A,T,C or G
aatgagctattkaacracgcacatctatcrgggactgttttagaatgtttctgggtggtaattttgtaattagagacaaaaacaacgacaattttctgtgataattgttgttttaattcctcttagtaatgacattgagaatacttataagctggaagtggtacgraaaaatacttgttgtaatcaagtttgattagtgaaatcctttactggttagtaaaggagaactagacgtaactcaggttaagtgacccgrtataaattggagtatttttactgttttttttttaatttatcaaagtatttcaaagtcaattattgataatttagcacanaaagttttcagtgaaaaataagttttatatatcattggacgamaatccattttttgtcactggccg

SEQ ID NO: 485 - DNA, 401 bp, Artificial Sequence
  Consensus Reference Sequence
  misc_feature 280: n = A,T,C or G
tggtaattttgtaattagagacaaaaacaacgacaattttctgtgataattgttgttttaattcctcttagtaatgacattgagaatacttataagctggaagtggtacgraaaaatacttgttgtaatcaagtttgattagtgaratcctttactggttagtaaaggagaactagacgtaactcaggttaagtgacccgatataaattggagtatttttactgttttttttttaatttatcaaagtatttcaaagtcaattattgataatttagcacanaaagttttcagtgaaaaataagttttatatatcattggacgamaatccattttttgtcactggccgagggtttttataaacatcttycattttaaaaggttttatattttgattaacacac

SEQ ID NO: 486 - DNA, 401 bp, Artificial Sequence
  Consensus Reference Sequence
  misc_feature 114: n = A,T,C or G
ggagaactagacgtaactcaggttaagtgacccgrtataaattggagtatttttactgttttttttttaatttatcaaagtatttcaaagtcaattattgataatttagcacanaaagttttcagtgaaaaataagttttatatatcattggacgamaatccattttttgtcactggccgagggtttttataaacatcttccattttaaaaggttttatattttgattaacacactatttcacccstttctagtgtgatgtattgtattccaattattttgattaattatatttgaaggaaatgttattaaaactcctttttgtaaatagttcatggaaccaatgattagtattttaattttcttktgccaataaatgcagtttctttagttggtttagtg

SEQ ID NO: 487 - DNA, 401 bp, Artificial Sequence
  Consensus Reference Sequence
  misc_feature 69: n = A,T,C or G
agtatttttactgttttttttttaatttatcaaagtatttcaaagtcaattattgataatttagcacanaaagttttcagtgaaaaataagttttatatatcattggacgamaatccattttttgtcactggccgagggtttttataaacatcttycattttaaaaggttttatattttgattaacacactatttcacccctttctagtgtgatgtattgtattccaattattttgattaattatatttgaaggaaatgttattaaaactcctttttgtaaatagttcatggaaccaatgattagtattttaattttcttktgccaataaatgcagtttctttagttggtttagtgaccgtgagcaaaaagatgatgtggatgaaattcatgacgaggtat

SEQ ID NO: 488 - DNA, 401 bp, Artificial Sequence
  Consensus Reference Sequence
tgaactcattttyagatgtttgatgccaaaagaaaaaggatgagttacccagctaatattaactgcatgtctttggaacttgctcttgttgcaacgttagcatcattagyttatgatatttgaycatcattagcttagtcttttttatacttgagtatattgcttttggtctactracccaacaatcaaggtacgcatgtcattagaatttggtttagacttttttaactgaatttggtcttccgtgttcamcaaggcccagtgtkgtgtttgtgttcttactttgtttgtttgggttcagttgtcttcaatcttcatagtactagaaaaaaagtcatgatcaccatcttataattaagtatttttttattttttataatatatttgtctaaattattttt

SEQ ID NO: 489 - DNA, 401 bp, Artificial Sequence
  Consensus Reference Sequence
tgataaaagaaaatcttcaactactattgcattcggcagttgcatgtgcaattttaatgggggaccctcatttcccagtcactgtctatatctattmctaaaagacagctgaactgatatcgtaaatcattcctgtgcarggaataaatacaggagaaatgtaatgggttacccagaaattatataaatcagtttaatataatattttaatttaaaatattaaarctcaagttttatggatattttttttatttatatggtgtttaatcwtcttatkcagactgaatgtgagacttgactttacatttatattccaacaatttctaatttttggactctgaagggaagcgtgtggcagtcaagtattactcagatgactggccaacaaacaatgcaaagtt

SEQ ID NO: 490 - DNA, 401 bp, Artificial Sequence
  Consensus Reference Sequence
agtgaaaccctttaytggttaataaaggagaactagacgtaacwcaggttaagtgacccggtataaattggagtatttttacttttttcyttaatttatcaaagtatttcaaagtcaattagtgataatttagcacacaaaagttttcagtgaaaaataagttttatacatcatwggacgacaatccattttttgtcactagccgagggtttttataaacatcttccattttaaaaggttttatattttgattaatacactatttcaccccctttctagtgtgacgtattgtatttcaagaagataacaccaattaacgtcraccaaaaaaatccctaaataatgttagccaaaaaataactttggtcaatgccgaccaaacaatcctagccaacatcaac

SEQ ID NO: 491 - DNA, 401 bp, Artificial Sequence
  Consensus Reference Sequence
gtgataatttagcacacaaaagttttcagtgaaaaataagttttatacatcatwggacgacaatccattttttgtcactrgccgagggtttttataaacatcttccattttaaaaggttttatattttgattaatacactatttcaccccctttctagtgtgacgtattgtatttcaagaagataacaccaattaacgtcaaccaaaaaaatccctaaataatgttagccaaaaaataactttggtcaatgccgaccaaacaatcctagccaacatcaaccaaaaatagycttagttgacttcaaccgaaaaaacttaaccaatgtcggccagaaaataacctygatagwcattaggcaaaaaataccctagttgacattgaccaaaagatagcatcgatc

SEQ ID NO: 492 - DNA, 401 bp, Artificial Sequence
  Consensus Reference Sequence
ttttataaacatcttccattttaaaaggttttatattttgattaatacactatttcaccccctttctagtgtgacgtattgtatttcaagaagataacaccaattaacgtcraccaaaaaaatccctaaataatgttagccaaaaaataactttggtcaatgccgaccaaacaatcctagccaacatcaaccaaaaatagccttagttgacttcaaccgaaaaaacttaaccaatgtcggccagaaaataacctygatagwcattaggcaaaaaataccctagttgacattgaccaaaagatagcatcgatcgaaaaaamttttgacaacatcgaccataaaaaagtcacaaccgtyaaccaaatataaacccktgacgacattaataaaaaaatagtctc

SEQ ID NO: 493 - DNA, 401 bp, Artificial Sequence
  Consensus Reference Sequence
aaatccctaaataatgttagccaaaaaataactttggtcaatgccgaccaaacaatcctagccaacatcaaccaaaaatagycttagttgacttcaaccgaaaaaacttaaccaatgtcggccagaaaataacctygatagwcattaggcaaaaaataccctagttgacattgaccaaaagatagcatcgatcgaaaaaaattttgacaacatcgaccataaaaaagtcacaaccgtyaaccaaatataaacccktgacgacattaataaaaaaatagtctcgactgatgacaactaaaaaatatcatcacgtgatgttggtcgaaaaaactctgttmtaaatcagccaaaacatagccttkaccaaagtcgactaaaaaatccctacttagcatcatcca

SEQ ID NO: 494 - DNA, 401 bp, Artificial Sequence
  Consensus Reference Sequence
atcakacatcctatacagagaaatataacaaaaattaattgtatattcacaaaaagagaacataaaaagtttcataatagagaacagaaggcaagtttcataatagagaagagaagagaagaagtttgagaataaaaagagaacacaagaggagaggtttgacgatagaggccagatggayratgaacaccatgaaaaacacgatggcaacagtgtcgttatagtcatcgtcgaaaccccaaaaacaatcrtctgtcgacgaygaagayactagccaacgacartgtcattatgaccaaccaataaaagtcatatgcgtakaaaaaaatataaaaaagcatacaaaaacracayagcatatgataaagtccaaacctgggtgtgcgtcgttgtggtcacca

SEQ ID NO: 495 - DNA, 401 bp, Artificial Sequence
  Consensus Reference Sequence
gaccyccaacactgagatgggtaagcatgcccatggatggccatgctaggccgctcagtagtttctcacaattgacaatcchaactgttctcaggttaggtggcatacccccttctgraaaysactcaatttctgggcagtwggatatgtaaagatgttctaactttgggagaagagtactcatctcatcaggcaacgacatcaacttgtcagagccccaaactttgaaagtaatcaagttgggcgcagacaatccttctctccagaatgatacaaagttggggcattbrtaaattctmaaagaabacagactcttaaatgactctgcccctgaaacmaaaagatattccatattttcacagtwtctgattgcaagatctctgagatttggaaaggtaacc

SEQ ID NO: 496 - DNA, 401 bp, Artificial Sequence
  Consensus Reference Sequence
gaatggcgggagccgttgggagagaagagacaagcagctcgcaatcactaatataaagtgtttccagagccaagtattctaagacttttaagcaaaggaaaagcttctgaatcaaaggaactccacaactcccaacaaggcatgtcataaatgaacagagataaagggcctccaagaacgacaatcttcattcttgtaaaarcctgcatcgatagtcttcagcctattcaatcttgaaattacaaggaaccgwgagaaggtagctgttcaagtgaaggaagcatactacagttgtcacaatcacttaaggttagacgtgtcatattgcrgtaggaagaatttcccatccaatctggaaatctggttcctttatagccttttatttgcaamgattcaatgtt

SEQ ID NO: 497 - DNA, 401 bp, Artificial Sequence
  Consensus Reference Sequence
aatggcgggagccgttgggagagaagagacaagcagctcgcaatcactaatataaagtgtttccagagccaagtattctaagacttttaagcaaaggaaaagcttctgaatcaaaggaactccacaactcccaacaaggcatgtcataaatgaacagagataaagggcctccaagaacgacaatcttcattcttgtaaaracctgcatcgatagtcttcagcctattcaatcttgaaattacaaggaaccgwgagaaggtagctgttcaagtgaaggaagcatactacagttgtcacaatcacttaaggttagacgtgtcatattgcrgtaggaagaatttcccatccaatctggaaatctggttcctttatagccttttatttgcaamgattcaatgtta

SEQ ID NO: 498 - DNA, 401 bp, Artificial Sequence
  Consensus Reference Sequence
cgaaaccaaatcatcaaaatactcatgaccaacctcttctaaagtcctacctktgcwtgatttcttcaaaagrtcttcggccatccacaacaagaytaattcatatttttcaaattcgtaatcttgtggatacaaggaacaataaacaaagcaccgtttwaaatgtggagggagataatgataactaagtctcagtgctgaaataacttcacactcactttcagaaagttcccaaatgycactattsagratattattccaatccacgatgtcatgctttcttctcaacatgcctccaagcgactgtgctgctaaaggcagtccgttgcactttttaacaatctcctttccaattttttctagtgttgttgtgttcycgtccgattccgaggaaagacacg

SEQ ID NO: 499 - DNA, 401 bp, Artificial Sequence
  Consensus Reference Sequence
atgagactcaagtgtgacaactatgtcctccaacttactaccgatcttcckatyrgaaaagcgagaaaamaagtytcttaccttgttttgggtggcagctttggtgaaaacatggtcgagtaagtcatcrgcttcatagacagcatctttgagatcattgagccagtgtttgacattggtgtttgygrtctgtttcttctcggcatcatcaagcacagctccaaccactctsagartggtctccaacttttgaagcaacttcttgctaagcttctttccaaggatcaagtsaacaaactcaggtgaasccagcctgtcgaaaagcacatcaaggaaagcwgagagaaaggcaccacctaccactgctkctgccatyatctcaagaacaaaagatgatcaga

SEQ ID NO: 500 - DNA, 401 bp, Artificial Sequence
  Consensus Reference Sequence
gataaggttttttttatttattatttgtwttattatggtggtgggtgacttatgacttatgactagtttcatttctgttwccaaaccgtgtggagcagtggtgtatgtttttttctttcatttctgaawwtgyttgyaggtttcayaaaacactgatcccttttctwtgtgatwtgtatggatggctgcaagggtactgyacgtatttaagttcctgtctttaatggtctgtaagacaagttgtrttaaggcagattgtacatgtgtttgtatgaacggtacaamagttgattycacaaatctaatttatatttggatatttttattccaaaaataagttagtagtaaaattgaaaataattttttttgtgtaatccawaagttatctaaaaatacttaac

SEQ ID NO: 501 - DNA, 401 bp, Artificial Sequence
  Consensus Reference Sequence
  misc_feature 64, 82: n = A,T,C or G
gttttgatgtcttattattatcaattgttatattggattatgaagtatggatgrattttttttnctcaaataatgttagttntatatacttatatatagatraatatataattttaaatttttataatatatcargtcaaaccagtccratgactggtccaacaccaytgacccactcaccaactattttgatttggtcaatgatcgaactgagtttmacaactatagttgcaagtataacattacaataaacacttaaaaaatagaaaaayaaaacttwgttawaacaaacataatgataaacataatattgatttaaaagcttattattrtgtttattctaagttatgtktgattttctrtttttttaaagtatttattataatgttatatttacaaca

SEQ ID NO: 502 - DNA, 401 bp, Artificial Sequence
  Consensus Reference Sequence
tttttattgaaattaagaatwtttttatyatgaaaatctcccttattaaatgtaacaaattaaatattttactctatyatttttataaatactagtcaatgcttwaakaacatttaataaaaaaaattattattttgaatacataaagataaagaatataccatactataatatttggtctttaaaattattaaacacatgcttgagacaacatttttatatgctaacaatgtgggyttgagaawcagcttagaagttagaactagaaggtgttagaatattctctaatgctctyatttattaaacttgacakcaacttctgycttttcttcctccttcttagttataacgcctytatgatcatcattcctctcattgcaccataaagcaaagaacacaaa

SEQ ID NO: 503 - DNA, 401 bp, Artificial Sequence
  Consensus Reference Sequence
ttgtgggttttaaagtgattttttctttctaarttgtctcyttttctctttgtttgtttcatgagaaacatccgtcatcwtggtgtaggggatttaaattttatgcttctgagttatttgtartctattagcgtgtttgatttcacatcatcgacgtgatcattmtctgggaatgtgatttcatgaagctactagttatagcttctacatatctcagayawgattttttatttctcaaactgatttccaacacgctatatatttcatgtgaaagaaaagacacataaattaytataaaatgtgtaatgtttgttaaacttggtttttgtgtagcatgagaagatctaagtgcrcgttcggtcaatttttaaaaataataacatttttaaaaataaacagta

SEQ ID NO: 504 - DNA, 401 bp, Artificial Sequence
  Consensus Reference Sequence
ttttctttctaarttgtctcyttttctctttgtttgtttcatgagaaacatccgtcatcwtggtgtaggggatttaaattttatgcttctgagttatttgtartctattagcgtgtttgatttcacatcatcgacgtgatcattmtctgggaatgtgatttcatgaagctactagttatakcttctacatatctcagayaagattttttatttctcaaactgatttccaacacgctatatatttcatgtgaaagaaaagacacataaattaytataaaatgtgtaatgtttgttaaacttggtttttgtgtagcatgagaagatctaagtgcrcgttcggtcaatttttaaaaataataacatttttaaaaataaacagtaaaaaattatgatattttaaa

SEQ ID NO: 505 - DNA, 401 bp, Artificial Sequence
  Consensus Reference Sequence
ataaattaytataaaatgtgtaatgtttgttaaacttggtttttgtgtagcatgagaagatctaagtgcrcgttcggtcaatttttaaaaataataacatttttaaaaataaacagtaaaaaattatgatattttaaaaccaaattctggtataggtggatggttgttgttttcatgagttaagctctctcttggtgagaagggtgtttgtgtttatttgcctttttctcttaacrgcaaatttgtaaattttttcctttttttttcatctggaaaattttaatttattgccaatatgtattgaaaataacttagtacatgtgacccaagcatgaaaatttgtagatagacggccaaagttaggtarcsattgtaatgsaaagtggaaccacatgcatctg

SEQ ID NO: 506 - DNA, 401 bp, Artificial Sequence
  Consensus Reference Sequence
ttgttttcatgagttaagctctctcttggtgagargggtgtttgtgtttatttgcctttttctcttaacrgcaaatttgtaaattttttcctttttttttcatctggaaaattttaatttattgccaatatgtattgaaaataacttagtacatgtgacccaagcatgaaaatttgtagatagacggccaaagttaggtaacsattgtaatgsaaagtggaaccacatgcatctgaaaaaaggtgccaactcagttatatttwtacttgcctatttgaaacyttactgaattttcgttttcttctcgagtktcattaaactctcccaactttagaagattaatttgggcagatgagtgtgaatgacttgatttgtctwtgtaattcaaaacagaatgcagg

SEQ ID NO: 507 - DNA, 401 bp, Artificial Sequence
  Consensus Reference Sequence
tattagtgtgctttctgccatctgcygrttgattgtttgattaaattttatttcttctgcgtaatgtgtggccatatttggtttccatttattcttgatttttgacaatcttacatttctgycatacttgtttagtcttsttttgttcttcttggtcatgaatygtttatttttaagaactctaaaaaccagtagactacctgagagaaatgtaattgatgtgctaaatactttgttttttaatcyagtcctgtttaaatatgatcaaaactcacctaatgycttatggttttgggattgttaaagtaaatagtcaaatagtcaaatatttacttaaattcgtgttagtttatatttcaaccggattttttataatcaaatatgaaatcaaacacaratca

SEQ ID NO: 508 - DNA, 401 bp, Artificial Sequence
  Consensus Reference Sequence
ttaattaataatcttaaaataaatttwaaaaacaaagtgattwaaaaaatagattgattaaaaacmcaataaatatatgattatcacatcttaattatattatattaagaaattaaaatactcaaataacataaaataytaaaaattaaagagacaaacatcataaatggaacatataataaarcaaaaatarcagaatgaactaacaataataattgaaacatgaaaataatgaaagcataaatmactaacacatgaatcattcccattaccaacctcatttgattattaatccttggtaaggaggcatgttacaacckattatagttttttaccaaacaactwcggtattcatactagaaaaaaaatgtgaaaattttcgataataaagacataacaga

SEQ ID NO: 509 - DNA, 401 bp, Artificial Sequence
  Consensus Reference Sequence
tctaacttattttttctcctcacaattatttttatcttttgtactaccaaacaaaaccttacaagagtacttgsttagtaggggtgrgaatakgtcargtcggcctacaggggcstatgacctggcctacataaagtctgacctatttaattaaaaggttaggctaagacttttttaaaagcctattagattaaatagaccaggcttagrcttattaaaaaaccttataaacctgataggccggcctatatatatatatatatatatatatatatatatatatatatatatatatatatatatatatatatatatatatatatatgatgtctcacaaagggaacgaggactcctttaaatagacccaagattttactgtatctacagtatcggtaatgttt

SEQ ID NO: 510 - DNA, 401 bp, Artificial Sequence
  Consensus Reference Sequence
tgycagaatacattggtccaggcgtcaatgtaatcccaataattatatcctrcagggtcaaaaggtgcagaaaatttcttgggttggttcaagttggagycataatgtcrtggctgcattacttttakgatctggattgtggagtgggtgtttrgatttgggtctttggggtccttgaaatgtttaatagatacggagttcgtatctattaggatgaattcatagaattttctggttttgtttatggytrttggcctataatgaaatcctggggggaatactttggcggtggccttgaaaggattcttatcccagtattytggttccatttgtaagacattgaaraatttgttttttgaaatgtagctgttgttgggttgtgatgttgagtcttgttgagt

SEQ ID NO: 511 - DNA, 401 bp, Artificial Sequence
  Consensus Reference Sequence
tacttttakgatctggattgtggagtgggtgtttrgatttgggtctttggggtccttgaaatgtttaatagatacggagttygtatctattaggatgaattcatagaattttctggttttgtttatggytrttggcctataatgaaatcctggggggaatactttggcggtggccttgaaaggattcttatcccagtattctggttccatttgtaagacattgaaraatttgttttttgaaatgtagctgttgttgggttgtgatgttgagtcttgttgagtcaacggttggctttgtttttkgttacagatggttttggtctgtttggctttttgaatttgtttttgcagatccattttagaatcatcgtctgattctgaggccatttctrcccaggtcy

SEQ ID NO: 512 - DNA, 401 bp, Artificial Sequence
  Consensus Reference Sequence
accttaggaggcatcgggaattttctgtaaaaattcacgggtgaggtagtcaggtagagagtttgaagagcccttgatatactctatgtcaaaatcaaagacgcttaaaattgcttgycatcttgcaaaaatttgttttgagacaaggcttttaacatccatttgtaaaatgtctttggctgatttgcagccaaccctaactaaaaatttttgattcaataaatcakattgaaatttggaaatgcacaaaacaattgctaaaacttcttttttaacrgttgaatattttaattgtgcaggattccaatgttttgaagtatatgcaaygacatgctcttgaccatgtacttgctgtttgaggatgccaccataaycgatgtctgatgcatcagtttcracaa

SEQ ID NO: 513 - DNA, 401 bp, Artificial Sequence
  Consensus Reference Sequence
ycggcaaactctattgatctttctattggaatgattgtaccttggtatatawtgtgaccaaggaatcgtattcgtgtctggaaaagattgatttttkatttggagactgccaaaccattctgtttaatgatatggatgaaagtctgaaggtgtttgaaatgttgatcaatatcttgggaaaagattaaaacatcatcaatatagacratgacgaattttgaataaggattgaaaatatcattcataatttttkgaaattctgaaggggcattcttcagtccgaatggcattacattccwctcatattgcccgaaaggtacagtaaacgccgttttgtacctgtctgattcttggatttggatttgccaaaatccagatttcatatcaaattttgaaaatac

SEQ ID NO: 514 - DNA, 401 bp, Artificial Sequence
  Consensus Reference Sequence
ratgacgaattttgaataaggattgaaaatatcattcataatttttkgaaattctgaaggggcattcttcagtccgaatggcattacattccwctcatattgcccgaaaggtacagtaaacgccgttttgtacctgtctgattcttggatttggatttgccaaaatccagatttcatatcaaattttgaaaatacttttgcagaatttaatctgttaagtaagtmttttttgtttggaataggatacctgatccattgtaatgcttgatttagtggtttgtaatttatgactaagcggggtgttcctygctcaatttcagattttttgttgacataaaaagccgcacaagaccatgggcttttgcttttccagattagacctttattaagtaaatccttaa

SEQ ID NO: 515 - DNA, 401 bp, Artificial Sequence
  Consensus Reference Sequence
aagaaartttgtgttaatcctaaggccttggttttcaataattrcatttgatagcttaaaattaatttttaattttgagtcgtttgctgtactttgtttctctgaggttttttcaaagaattttgtaggaattaatccttctaaaatacagtttgtgtcagcccttgtctcaaatagggccattgtttctaaaacaaaatcattaataattatttttatgtttatgtaaaatttttggattttaatcttgttgattaatcccataatatcatcttctagattttctggttggttttcctcaccrttgttgstactttcaraatcactaccttcctcaagctaagaaagaatgatytgatgaatttcttgttgttgaygaagttcttttacctcctttttta

SEQ ID NO: 516 - DNA, 401 bp, Artificial Sequence
  Consensus Reference Sequence
attttgtaggaattaatccttctaaaatacagtttgtgtcagcccttgtctcaaatagggccattgtttctaaaacaaaatyattaataattatttttatgtttatgtaaaatttttggattttaatcttgttgattaatcccataatatcatcttctagattttctggttggttttcctcaccrttgttgstactttcaaaatcactaccttcctcaagctaagaaagaatgatytgatgaatttcttgttgttgaygaagttcttttacctccttttttagattgtttatttctgtttggagatcttggatagtcgttggtttggttgaagaattttmtaaycttttgagtatgttacttacatcaaacttgttgtttgtaataaaatctttttgtcta

SEQ ID NO: 517 - DNA, 401 bp, Artificial Sequence
  Consensus Reference Sequence
gtgtcagcccttgtctcaaatagggccattgtttctaaaacaaaatyattaataattatttttatgtttatgtaaaatttttggattttaatcttgttgattaatcccataatatcatcttctagattttctggttggttttcctcaccrttgttgstactttcaraatcactaccttcctcaagctaagaaagaatgatctgatgaatttcttgttgttgaygaagttcttttacctccttttttagattgtttatttctgtttggagatcttggatagtcgttggtttggttgaagaattttmtaaycttttgagtatgttacttacatcaaacttgttgtttgtaataaaatctttttgtctaggttttacctccaatgttttcttgagtttttccag

SEQ ID NO: 518 - DNA, 401 bp, Artificial Sequence
  Consensus Reference Sequence
ataatatcatcttctagattttctggttggttttcctcaccrttgttgstactttcaraatcactaccttcctcaagctaagaaagaatgatytgatgaatttcttgttgttgaygaagttcttttacctccttttttagattgtttatttctgtttggagatcttggatagtcgttggtttggttgaagaattttmtaaccttttgagtatgttacttacatcaaacttgttgtttgtaataaaatctttttgtctaggttttacctccaatgttttcttgagtttttccagaaaaaccttcttttyctgggggtcrgggatggaattaattgcttcaaacaagagatcttgttctcttgttagagtattgatttkcctatcatcatcatccgtcgatga

SEQ ID NO: 519 - DNA, 401 bp, Artificial Sequence
  Consensus Reference Sequence
agttcttttacctccttttttagattgtttatttctgtttggagatcttggatagtcgttggtttggttgaagaattttmtaaycttttgagtatgttacttacatcaaacttgttgtttgtaataaaatctttttgtctaggttttacctccaatgttttcttgagtttttccagaaaaaccttcttttyctgggggtcagggatggaattaattgcttcaaacaagagatcttgttctcttgttagagtattgatttkcctatcatcatcatccgtcgatgataawtggtcatcttgttggattaagtttagatcttygtcggaaagtacggaggatgaagtttctrtttcttcctccgaagtttctatgagcaaattgtttatttgttcttcgattgt

SEQ ID NO: 520 - DNA, 401 bp, Artificial Sequence
  Consensus Reference Sequence
  misc_feature 222: n = A,T,C or G
catccgtcgatgataawtggtcatcttgttggattaagtttagatcttygtcggaaagtacggaggatgaagtttctrtttcttcctccgaagtttctatgagcaaattgtttatttgttcttcgattgtgggttctaggttaaggtttcttaatttcttctttagtctacaatacttactaatgtggccttgttttccacaattgtagcacattatttttnattttattktttgcttasgattttccatttccwtactagttgagggtttttgtgaatatcttctttttgaaaatcttcttttattggctggtttatgatcctggatttctytcctagaggattgttttttcttttgttttgggcargctggtaagccaaattgttcacagaaggaacct

SEQ ID NO: 521 - DNA, 401 bp, Artificial Sequence
  Consensus Reference Sequence
  misc_feature 192: n = A,T,C or G
ggattaagtttagatcttygtcggaaagtacggaggatgaagtttctrtttcttcctccgaagtttctatgagcaaattgtttatttgttcttcgattgtgggttctaggttaaggtttcttaatttcttctttagtctacaatacttactaatgtggccttgttttccayaattgtagcacattatttttnattttattgtttgcttasgattttccatttccwtactagttgagggtttttgtgaatatcttctttttgaaaatcttcttttattggctggtttatgatcctggatttctytcctagaggattgttttttcttttgttttgggcargctggtaagccaaattgttcacagaaggaacctaaatccttctttgtttgagtcttttctttg

SEQ ID NO: 522 - DNA, 401 bp, Artificial Sequence
  Consensus Reference Sequence
ctaccttttggacataggaaatcaattkaccatagcttaaattttcatatggaatgtctccattggcagattgactacgaattttatccctaaccttgtctcctaacgatctgggaagaccgrctagaaatttttctttccwgaaaggttgttggctatcttctctggtgtaaaccctagttaggaaagtatctctgtaccacctaaaatctgctaaggttctacacttaagatttgataataattctgyagacctatctttccataaggatgggtctccaataaaatgttgagctattgtaaaaattaaggtattgacagcgtcaggaatctstttatcatcgtcattagtaatgacttttccattgagatccgtcttaactgcgctgtaaattttttat

SEQ ID NO: 523 - DNA, 401 bp, Artificial Sequence
  Consensus Reference Sequence
tatmaaattctctaatatctttgcyctcatttggttccatagaaatatttccrtaagtaaatacgtaacaaaattttttggatctgaaatatttttaagcaaaaamtccttttttttwaaatagtttgaacgrmaatcctatarccaccagtatattatgtgttgatattttggttaaacagtacaccttarccttaytgccctttatccatcacgggtcttactgctacagtaccattcaactaaaatattagactamtgtacttccagaaartactgttcaaacatctattgtayagatcaaaataaaatattactcatagtatacaaggttcyagatccataaaatttgtttacatatgtccttacggaccrtattyctacttccccatcaggctctg

SEQ ID NO: 524 - DNA, 401 bp, Artificial Sequence
  Consensus Reference Sequence
  misc_feature 55, 56: n = A,T,C or G
tacatatgtccttacggaccrtattyctacttccccatcaggctctgataccagnnatatatatatatatatatatatatatatatatatatatatatatatatatatatatatatatatattattttttgggtaccaatatataatattattttttggatacaattaattttttttttttgaaactatcagactttgatcacactccataacttctattcctataatcaargactttaattgcaatttaggygagtcatgtgtccttttatattcctsattattttgattgactttcctttttctttaactttcctattatgttcctactccataaaatattaaatatttattgtgaagaagacttttaaaaaggctatyaggccaggycaggcttttaa

SEQ ID NO: 525 - DNA, 401 bp, Artificial Sequence
  Consensus Reference Sequence
  misc_feature 124: n = A,T,C or G
ccaratccygrttgcaccggtcygacctgatcagttttacacacaaaaagggaccatctctamgacatcattttgatatctaattattataaattgttatcttggattttgaagtatggatganwttttttttactcaaataatgttagttgtatacttatatataatatatacatatataattttgaatttwtataataaattaagtcaaaccagtccaatggttaatctatcagttggaccactgtccattcatcaaytattttaattggatcaatgaccgaacyaggtttcacaactatgattgcaakcataacattacaaaaaatamttaaaaaataaaataaaaaacaaacacaataataaagataatattgattaaaaaatttattattasattt

SEQ ID NO: 526 - DNA, 401 bp, Artificial Sequence
  Consensus Reference Sequence
attaaamwtwwaatttttatcttttaaagataaacttgtaagcatgagaaaagaaaatagttattaaaaaataaaaatgaaagayctttactcattcaatgattcgagtctgacccgygtgaactcaggattctgaatcwggaacarcgatctccgtccgatccacatgtaaggtacgaccrcraatyagtaacaracacatgtctcatcattcgtgcarctgccatttgtatatawagcacaacacragaagacgytaacyggctggtactgcaaatattcatccaccacgtggygccatatgatcaratgaccttgctactagtcacgggaagagcccgccttgtggttaggtgttgaaggatgtttggcgrcaaattraccaaatagggtywctttta

SEQ ID NO: 527 - DNA, 401 bp, Artificial Sequence
  Consensus Reference Sequence
ccatttgtatatawagcacaacacragaagacgytaacyggctggtactgcaaatattcatccaccacgtggygccatatgatcaratgaccttgctactagtcacgggaagagcccgccttgtggttaggtgttgaaggatgtttggcgrcaaattraccaaatagggtywcttttayaaatattttatcaaatagggtatgttttaaaactatggacgaggggggtctgttttttaatggatgtcgccattgaagctrgmgatacarytgagtcgccattggcactggcaagatagtgctgacrtggaggtgtttcgccattggcawtggcgaaacacgtracgtggaggtgggtctagccagcagcactggcraaacaggtgaggctagggcagctag

SEQ ID NO: 528 - DNA, 401 bp, Artificial Sequence
  Consensus Reference Sequence
ttttaaaactatggacgaggggggtctgttttttaatggatgtcgccattgaagctrgmgatacarytgagtcgccattggcactggcaagatagtgctgacrtggaggtgtttcgccattggcawtggcgaaacacgtracgtggaggtgggtctagccagcagcactggcraaacaggtgaggctagggcagctaggtatggtgttgywgagtaggggygcagtggttcaggatggtttcactaacatggctggygagtttgttttgaaagtatctcgycattgttgctggcgagaaaggtgcctacgtggcrcwcatgcatgcaaactgaaagtagcagcatataagaagyagrcttttccagaaaccttttcagaaagggtttcgcaagtgggagtg

SEQ ID NO: 529 - DNA, 401 bp, Artificial Sequence
  Consensus Reference Sequence
gtgttgywgagtaggggygcagtggttcaggatggtttcactaacatggctggygagtttgttttgaaagtatctcgycattgttgctggcgagaaaggtgcctacgtggcrcwcatgcatgcaaactgaaagtagcagcatataagaagyagrcttttccagaaaccttttcagaaagggtttcgcaagtgggagtggcagaataagcttctcccctawaaaacgatyatacrcraatgaatggaaacatctgygtattctggtgaatttcctagtgcttggtgcttgttacgcttgtgytggtggtgaaaagcatgagttgrgwattctcttcttgctttctcaaacttggtaaatagttaatatttgttgtgttaattttttttttctgttgcttgat

SEQ ID NO: 530 - DNA, 401 bp, Artificial Sequence
  Consensus Reference Sequence
ggwatatatattgttwaaatttttyttttgttattttaarttattttgggtattctaataacaaaaaacctckttactraaacttcaaattaaaactttattctaataaaaaattaattacttcaaataaatatcatgcmaraaacttaaaaaacttgtacrctttcaaagtagaaattttaaaggcamatcaaaccatcaacraagttgctattataaataattaatcttaaawataataacttcaaaacwaaataaatctaattaaaaaaaatactacrctcaaamtttarattaaaaatttattctaacaaaaaattaattatatgatgcagaaacttaaaaaacttgaaygctttgaaagtaaaaawtttaaaggcagaayggaaacctttgaaagt

SEQ ID NO: 531 - DNA, 401 bp, Artificial Sequence
  Consensus Reference Sequence
acttgaaygctttgaaagtaaaaawtttaaaggcagaayggaaacctttgaaagtagacattttaaaggcagaacaaatcattaaagaagttgytattataaataattaatctwaacattaataactwcaaaataaamaaaatctaattacaaaaaatactygaaactcaaattttattcmagactcaaaataattacttaaaataaataaaaacgatgccagagaagagaaattactgattgagagaaactttaaaaacacttrgaacactcagaaatttttaaaggcacaaagcatcarcacraaagyatcaacaygaagttgctayttaaagggcacarcacacctattttgtcaataccattggcgatatatgctcyttgtttcgccaacactgrtt

SEQ ID NO: 532 - DNA, 401 bp, Artificial Sequence
  Consensus Reference Sequence
aaactttccaagaagtctgttatgggtagggtagagagagagagactatgctaattactgggacttgtatcaatattctcatgcctttattcatgaatataatgctccttttatacaatggtgttacaccgttatggctcgtaacgaaccaagcttaacagaataacggtctaactaacgtaactaactggtctctaatgcgtgatacatcatgtacgtgaacctatatgtaatcctcgagatacttagggcgtgaggtttaccttctagaacgtccctcgtggttccttgttgcagaactaataccagtcgtagtgttgctaacatcaccttcccctgggaaactcaccttgtcctcaaggtgatgatgactgcgaatatcctcccagttttcccaagtt

SEQ ID NO: 533 - DNA, 401 bp, Artificial Sequence
  Consensus Reference Sequence
tcatgtacgtgaacctatatgtaatcctcgagatacttagggcgtgaggtttaccttctagaacgtccctcgtggttccttgttgcagaactaataccagtcgtagtgttgctaacatcaccttcccctgggaaactcaccttgtcctcaaggtgatgatgactgcgaatatcctcccagttttcccaagttgagtcctcaggtggtaaaccctcccattgtataagtactgagcgagtagggggagacgtggaggtatccagtcgcgagttgaggatagtaagtggcttcaaaagaggttgattgtggaccgcgtctggtggtaacggagaygttgggagttcaaaagggccgtggtgcggtcstaacaacgagcagtgaaatatgggatgtattctaga

SEQ ID NO: 534 - DNA, 401 bp, Artificial Sequence
  Consensus Reference Sequence
aaactcaccttgtcctcaaggtgatgatgactgcgaatatcctcccagttttcccaagttgagtcctcrggtggtaaaccctcccattgtataagtactgagcgagtagggggagacgtggaggtatccagtcgcgagttgaggatagtaagtggcttcaaaagaggttgattgtggaccgcgtctggtggtaacggagacgttgggagttcaaaagggccgtggtgcggtcstaacaacgagcagtgaaatatgggatgtattctagatccttgaggaagctgcaggcggtaagccacttgtccaatacgttccaagatgcaaaatggtccaaaatagcgtttggcgagtttattgggccttccctgtcgtaacgaaagttgacgataaggccgtagttt

SEQ ID NO: 535 - DNA, 401 bp, Artificial Sequence
  Consensus Reference Sequence
gcgaatatcctcccagttttcccaagttgagtcctcrggtggtaaaccctcccattgtataagtactgagcgagtagggggagacgtggaggtatccagtcgcgagttgaggatagtaagtggcttcaaaagaggttgattgtggaccgcgtctggtggtaacggagaygttgggagttcaaaagggccgtggtgcggtcctaacaacgagcagtgaaatatgggatgtattctagatccttgaggaagctgcaggcggtaagccacttgtccaatacgttccaagatgcaaaatggtccaaaatagcgtttggcgagtttattgggccttccctgtcgtaacgaaagttgacgataaggccgtagtttgacrtagactagctgtcctacctcgtactgaa

SEQ ID NO: 536 - DNA, 401 bp, Artificial Sequence
  Consensus Reference Sequence
aaacgtccttcgccatggaaggccactgaaagcttgattgcaggcggtgtagggttttctttattccaaaatgacccccaattggtgttgcatggaactcatgtaacaaggaaggtatgaaggaattctttgaatctagccagatcactcctcaaaaaaggatgaggtcgccggagatggcaaaatcgcgatactgctccagatgggcaagtacggcggcgcgttgttgctggaattcagggctggccttaaacgtctcctttaactgagtcataaactcatggtgaggtatcgaaaggataaggcattgagcctgggacragcagtcaatttgagagagagaatctgcgactatgttagaagaccctgccttatattgtatgtcatagtcaaaacccaaa

SEQ ID NO: 537 - DNA, 401 bp, Artificial Sequence
  Consensus Reference Sequence
aggaattctttgaatctagccagatcactcctcaaaaaaggatgaggtcgccggagatggcaaaatcgcgatactgctccrgatgggcaagtacggcggcgcgttgttgctggaattcagggctggccttaaacgtctcctttaactgagtcataaactcatggtgaggtatcgaaaggataaggcattgagcctgggacaagcagtcaatttgagagagagaatctgcgactatgttagaagaccctgccttatattgtatgtcatagtcaaaacccaaaagcttggctaggtagaactrttgttcaggtgtctgaaccacctgagacattaattccctaaggctcctttgatctgtgtagactgtgaaccgatggcccagcaagtattgccgccatcgt

SEQ ID NO: 538 - DNA, 401 bp, Artificial Sequence
  Consensus Reference Sequence
atatatcaatatatcataaaaaaaaaccgctacgcatttcctcaggaaggggttgagtaaagcattcatggctgcttggaaggtcgagggtgygttgcataacccgaaaggcatcactctatactcatagtggccattgtgggttcgaaaggcggttttaggaatgtcactatctgccattaaaatctggtgaaaaccctctcgtaagtccagcttcgaaaaccatgaagcatggccaagctcatccaagagttcttcaatggtgggtattggaaaccggtctcttattgtgatcgcgtttaatgctytgtagtcaatgcacatgygccatgtgccgtccttctttttcaccaataacacgggtgaagagaatgggcttctgcttggctgtattaacccgg

SEQ ID NO: 539 - DNA, 401 bp, Artificial Sequence
  Consensus Reference Sequence
catagtggccattgtgggttcgaaaggcggttttaggaatgtcactatctgccattaaaatctggtgaaaaccctstcgtaagtccagcttcgaaaaccatgaagcatggccaagctcatccaagagttcttcaatggtgggtattggaaaccggtctcttattgtgatcgcgtttaatgctytgtagtcaatgcacatgcgccatgtgccgtccttctttttcaccaataacacgggtgaagagaatgggcttctgcttggctgtattaacccggactcgagtaaggcagtgacttrtttttcaatttcrtttttctgagagtgggggtacctataaggtctaacattgactgggtgagctgaaggaatgaggttaatgtgatggtcatgctgtctrggt

SEQ ID NO: 540 - DNA, 401 bp, Artificial Sequence
  Consensus Reference Sequence
tctattaagatagtgacacgtgcgtggttgataacaccatataagcggaaggtatcggtggccgggactcccgccataacatgtaagctgatgtgaggttggagaagamtggggtcgtagggtgggggtgtttctgttaaaggttgaggaagggtttcgtggaggttattatcggaagctgagggcgcatcggagtctgcaatgaacaagagcacacgccctttacatcgatgggaggagctccatttttcgtcacaattgtagcataggcctttttcgygcctatgcatcatatyttcaggagtgcgctggataaagggagtcttgggtcgagggtgttgagtcagagtggaggattgcggagttgaggtttggggtatcagtgaggagggccgtgagtt

SEQ ID NO: 541 - DNA, 401 bp, Artificial Sequence
  Consensus Reference Sequence
tcccagtgggtcatggtygtcaaaacgtggtacgtcaagcttgacaggagggcgctgatgtatacgaggggaagaggatggttgttgatatggcggtatggaagaaaagcgttcacacatggcgtctactctagaggctagctcggagtgttttgcrgcgagggtggtgagggcctcctcgaggcggtcggtggtggcgcagcgagtaccgtgctccgccataatagcaggtcggaccaagatsttatgggtagggtagagagagagagactatgctaactactgggacttgtatcaatattctcatgcctttattcatgaatataatgctccttttatacaawggtgtyacaccgttatggctcgtaacgaaccaagcttaacagaataacggtctaact

SEQ ID NO: 542 - DNA, 401 bp, Artificial Sequence
  Consensus Reference Sequence
ctgcatataaacatcaaggttcatacctggaccttttggaccaggaataagcaatgaaagtataaaattaggttgcttcatacgcatccatggaggaagattgtacggaatcaagataacaggccaagtgctatgggaaattgccatagttttgaaaggattaaagccatcagtagycaaacctagtcgaacattacgagcgtcacaagcaaaatcaggataytgacaatcaaaattcttccaagcaaatgaatcagctggatgcctcaggagtccatctttagttcgaccaacctcatgccatatcatagaacaagctgtttttggtgatacaaaaagtctttgcaatctaggtataagagggaaccaacgaagaatctttgctggtatcttttttctac

SEQ ID NO: 543 - DNA, 401 bp, Artificial Sequence
  Consensus Reference Sequence
aagtattttcctctggtaatgcatcacttaacagctctaacaacatcgaaaaacttttatcagtccacccatttagacactttaagtgatacaaatgtacaaggaatgacaattttgtaaacttcwtacaacctttataaagactttgctctgcctcccttaacatctgatagaacttatctgaattattattgtcttcagatttttgaacactcggtccattcataaattytctagaatctccatcctccatatttatatctrtgtcattactctcattagttgcatgcattgtgaatgcatcatgaaccaatgtatccatgtcatgatcaaactccccttccacttgggatgtatctaaagaactagatgggccaacttgttcaccatgaaagatccaa

SEQ ID NO: 544 - DNA, 401 bp, Artificial Sequence
  Consensus Reference Sequence
tctrtgtcattactctcattagttgcatgcattgtgaatgcatcatgaaccaatgtatccatgtcatgatcaaactccccttccacttgggatgtatctaaagaactagatgggccaacttgttcaccatgaaagatccaagtaacatatccttttagaaatccattactaataatatgctcataaacattcatccgagaacrccacttgcaattgacacatttggtacaagggcataaaattttcccatcctttgacgwtttcgcaaatgcaaaatctagaaaatttaaaattcctctaatatacttctctttattaagagaattgtagtctatccaactcttatccatttgataaaataaactgaaaaagtagaataaaatagacataataaattagtg

SEQ ID NO: 545 - DNA, 401 bp, Artificial Sequence
  Consensus Reference Sequence
ctaagaataataggttaataagagtggattaaaattaataattattagtaacatcttttttattaaatgcttttacagyattcttttttttaataagtaaaattctatgttgcccaattactaaagagtaggcttgatttattcggtgagattcactcatgatttattaaataaaaaatgcttaaaatagtaaacaatatgtttactagaattcctcattgaaaattagaaacttcttcctaccgttaactttataaaaacatatgtatcttttaataattggtgagtaatatatatattgtcaacctctattaacttcatcttatctagagtaatattctctctcaaaggctgcagacaacagggaagcaaaaatggaccttgaatttgggmattaaaat

SEQ ID NO: 546 - DNA, 401 bp, Artificial Sequence
  Consensus Reference Sequence
tattgtcaacctctattaacttcatcttatctagagtaatattctctctcaaaggctgcagacaacagggaagcaaaaatggaccttgaatttgggmattaaaatcagaaattaactaaaaaggtaggatcattctttcattcattcacacttaattttcttgttcggtgactatcacctatatataggaacaagaaatcaagcaaacatttttttatgttgggtgactattcatccaatagaaatcaagcaaacatttttatatttatatggaaagaccataattttgaaaagtacttgaaatatgatgagcccaatgaggactggctgtgtatcaaaccaaaagcttcgatacagataagctgaatttcgcactagtgtatatcctccaaattgtagaa

SEQ ID NO: 547 - DNA, 401 bp, Artificial Sequence
  Consensus Reference Sequence
gaatgtaactatgaggtattcaacacattccaaatttttgtctacattccaaattgcttagccacttagacccctaaagataagtcccaaactttttgtccacattccaaatttaccgcacacttctaaaatcatcctcattgtcggtcaatagcttaaactattttacagaaaaccaataatacatacacacacacacaaaaatcgaaaacaaaaactaccaagttcctatcctaatcctccataataactaaaacagattacacaaattccaacaaactccactgattgcttcatccgaaacaccaccaccacaaaaaccaaaaaaagaaaaatcmaaaccagattgaacactcaacgaacaaaaccaaccaatcttcaatccgatcrtccgaaaacca

SEQ ID NO: 548 - DNA, 401 bp, Artificial Sequence
  Consensus Reference Sequence
acacacacacamaaatcgaaaacaaaaactaccaagttcctatcctaatcctccataataactaaaacagattacacaaattccaacaaactccactgattgcttcatccgaaacaccaccaccacaaaaaccaaaaaaagaaaaatcmaaaccagattgaacactcaacgaacaaaaccaaccaatcttcaatccgatcatccgaaaaccacaaatattcaaaattcaacattttcgttgaaaaaattccaacagccaccatctcacacactcatctcaaatcgattcacacaaaaaaaaatccacaaagttttagawtgaaaaaaaaamasataatccaaacacaaaaaaagaaggaaaaataaacaacctcacagatygatcyggcaagctgcggaaa

SEQ ID NO: 549 - DNA, 401 bp, Artificial Sequence
  Consensus Reference Sequence
atctcaaatcgattcacacaaaaaaaaatccacaaagttttagawtgaaaaaaaaamasataatccaaacacaaaaaaagaaggaaaaataaacaacctcacagatygatcyggcaagctgcggaaaakagaaagggatcagggaggtgaatcgcgatygaagtgaagatcgtgagtggaaagsgcggagaatgcgtagtggtggaaagaggaaaaagacgttggaaacagtgagagagagagagcaaagaaaggaaactaaggcraaagcatcatggtcgtcatcggaaagagagaaatttagggttccgaagaagaagaagagaaaagagatatggggtgggttattacccttcctttggttatcgctctctattgctcttttttttcttctttttttt

SEQ ID NO: 550 - DNA, 401 bp, Artificial Sequence
  Consensus Reference Sequence
caagagaatagtattcaaattcaaatagtcttaaagagttttacctacaccaacaatcataggtataagactagattttgtgaagttttatctacatcacgtagttgtaggtataagttttttaaaattttgcctacactgtgcttctgtaggtaataattcttttgagttttatctacactaatcaaccataggtacaaattttttggagttttacctacacaacatagttgtaggtagaagtatttttttagttttaatgaatttgcctacgccaaataatggttggtacaagtggttgagttttacttacattagtcaggcgtagrtaaaagtattgttgagatttacctacactagtttatgtctgtagcaaaaaagcgtctgtaggcataggttat

SEQ ID NO: 551 - DNA, 401 bp, Artificial Sequence
  Consensus Reference Sequence
  misc_feature 373: n = A,T,C or G
tttgcctacactgtgcttctgtaggtaataattcttttgagttttatctacactaatcaaccataggtacaawttttttggagttttacctacacaacatagttgtaggtagaagtatttttttagttttaatgaatttgcctacgccaaataatggttggtacaagtggttgagttttacttacattagtcaggcgtagataaaagtattgttgagatttacctacactagtttatgtctgtagcaaaaaagcgtctgtaggcataggttatttttcttgtagtatrtaattcaattttattttgtatattgyatgtaggctaccgtagttttttttccaacaaaatgatttgtattaaatggtaccaaaantacctaagatccaaaaacatatacacca

SEQ ID NO: 552 - DNA, 401 bp, Artificial Sequence
  Consensus Reference Sequence
caaacaccagcaagagaagaaagttcatggttttttgccttatataacaaccactgccatgagatatgttttacggctgtcaaaataccccctggttcacactttttgcaactaaaggctatcatataaaatatttmtgttggccraaatcggtttcttttgatcgacatyggtcgaagttattttttgtccaacgttagctagaaattttttttgtcaacgttagtcaatgatgtttgtgattgatatcaaccgatgataatattttatcaacatcttgtcagggctatttttcgaccaatcgtaaccttggtttttttggtcaatgtgacaaagcttcgttaccaggaacaacttgaggcacttgtagactcgcttgtcaggtttttcatcattgacac

SEQ ID NO: 553 - DNA, 401 bp, Artificial Sequence
  Consensus Reference Sequence
agaaaaaaaatatgaaatcaagatcktgtggagtgtctaccaatctcaargctgaactccatgccatcttttawggtctctrtcatgccttgaatctaggcttcaattagtttaygagtctgattctatagtggctcttaaactcrtcctaggaagaaattaagtaattaacswacaagtttcatcctcacgtatgctacactcatcaacttaatcagctcactgctggagcaagattggaggatccaggttcagcatactcttcatgaagacacgtatgtgcaggttggcatgcaaagttaatttggaghgtgataattcatttctggtttggcaaaatttcccacctcaagtatctgtgtctcttttagtaaatgcagtagggattctaagattatgtg

SEQ ID NO: 554 - DNA, 401 bp, Artificial Sequence
  Consensus Reference Sequence
attcatacacactatagttctaggatattctaccattttcatacatattatatttaagaatattctaraaatttgtarcaatttcaacactcctgcttgatgcaaatttctgtgactccgagcatagctcgtaattcttcaaatcttggtctcggcaacgccttcgtgaatatgttagcaatttgatcttctgttctgcaatagtcgagtttgatctctttagttgctttagcttctctgataaagtgatacttgattgctatgtgttttgttctgywrtgatgaactggattcttcgccattgyaattgctgatttgttgtcgcwgttgattttagtaggctcatcttrtttttctcccatgtcttcaagtatccwacgaakhcatatagcttgactcgt

SEQ ID NO: 555 - DNA, 401 bp, Artificial Sequence
  Consensus Reference Sequence
gcatacattatgtcaggccrtgtagcttragacttgatgtaaagtgtaggctcactcttgctcctactgaatcctcaatccatgaaatactaatcgattctactataccatgctcgaggtgyttgctttaaaccgtagaatgcttttcttagtctgaacactttgctttctttgccttcagacacgaatccttttggctgctccacatagatcttttcttcaagtacgccgttaaggaaggcggatttgacatctagttgatggatactccatcctttttgtgacgcaagagctattagaactcttatggtatcaagacgagctactagtgcaaatgtctcattgtagtcaattccgggttgctgtgagtaaccsttagctactagcctcaccttgtgttt

SEQ ID NO: 556 - DNA, 401 bp, Artificial Sequence
  Consensus Reference Sequence
tggagatgaaggtggttcacctggatcttcttcctcagcttcttcttgaggtagttgggcgagtataagaatgttcttctccactttttcttcatcccaattccaagaagtgtactcatcaacttcaacatctcgaytgatgacgagtttcttagtktgcaagttgtagacacggtagcccttagagatattgttatacccaaggaagatacctcgtatagtcttgtcttcaagcttgtgcctcttcacgtctggaatattaatgtagcatatagatccaaagacccttaggtgctttgttgatggcttcttcccgttccaagcttcaattggagtcttgtcttttacagacttagttggacatttgttgagtatgtaaacagcagtgtagactactttag

SEQ ID NO: 557 - DNA, 401 bp, Artificial Sequence
  Consensus Reference Sequence
gaactttttgaatactccaaagaattctgatttttcttttagaaaatatacccatgtcattctagagaagtcatcaatgaagagtatgaagtacctgttgttctcatgtgatgacgtcctcattggtccacagacgtccgtatgtatcaagtccaacagatctttcgctctccatgctcckcttgttgagaaaggaaatcagtgttgcttaccaaggagacatccttcacacacttcattgttctcctttatgcttggaagatctctyatcatgttcttctcatgtaacaatttcaaggcatgtgtgttgaagtrgccaaatcttcgatgccatarccatgaatcrtcaacttgtacctttatctgtctccacyatgayagtgcctttgccttttgattcr

SEQ ID NO: 558 - DNA, 401 bp, Artificial Sequence
  Consensus Reference Sequence
ttgaaatttaagctttgattggaaggcattttcaagtgtatcttctttatgtctatacagtctttgctcatatgcttcaagagagcccacaagttctgtctckgatagagtggacagatctttggtttcctcaatcrttgtcacgattgggtcaaacttttggggcatagtaattagaattttctcaacaattttcttataaaaaatatmttccccaaaagctctcatttgattaactatttctttaactttagaacagtaatctttaactgtctcagactccttcatcttcaatagttmaaaatctcttcttagagattgaagtttaacggcacgtaccttaacacttccttgaaactcctcctgcaatgtgttccacgcttytttgvyagwcttagctc

SEQ ID NO: 559 - DNA, 401 bp, Artificial Sequence
  Consensus Reference Sequence
gctgaagtatctgtgggaacggtgaaaccttcttctaytatgtcccataaatcttgakatgaaaaatatgtttccattttaacacgccakaaatcataattttcacmattgaagatagggayaaaaatagttgacgattgagtagtgttatccatagcttagaaaaaatattattggagtgggttaataatacaaagaaaawttttcaagtagttkggaggattttggaatggtaggtagrtaatataactaygccyaatgtatgaccraacgtagctctrataccamtgttgatagttgattagatgatagttgatagttttagagaattgttttagaaagaaggccatgtcattgatttcttggatcatcaattacaacataccaattgcctatttaca

SEQ ID NO: 560 - DNA, 401 bp, Artificial Sequence
  Consensus Reference Sequence
ggggggwcggatgtgcttcattttgaggaggctttttccggaacaggtttgttatatttttattgcatgttatttagaattaaagtctagttattatgtcagttgtgcatatagcttgcgtcaagtgaatcaacaaagattgaactcgattcatattatattgatttaatagttatgtttcttaactgggaaaatattgacattcttagaacatctttagtcaaagaatccattttaggttcttggattatttttttgggttccatgatgttataggatgcaagaatttttatcattttttgttctagtagtagaatctaatttggattattagattttactagcacaagaaaaaaaatatttttgaaaaaataggagttcttgggagttcttttcctaga

SEQ ID NO: 561 - DNA, 401 bp, Artificial Sequence
  Consensus Reference Sequence
atggaccccctttccccaaagaaaaccctcctctttgttttcatcatttccttctcttctcttcacctacaacacacaagtgggtttgagggccaagtgtgagagagagattgggagagaagtcaggtttgagagttgaaggaagttactggtggtagctggtgttggcacgagcaatggcacgaatgacagcgccagtgatggccggtggctaggttggaggtgacccttgagaagggagaacaagaggagataaccatgaaagctagagtttgyggaaagagctcatgactacgaaaggtcgacgacaagtttagacatcactatcccactcattttttcgtgctctacgcaatggaccgagcrgaatcgcattttggggtaaggttttgttgaccttc

SEQ ID NO: 562 - DNA, 401 bp, Artificial Sequence
  Consensus Reference Sequence
acaagtgggtttgagggccaagtgtgagagagagattgggagagaagtcaggtttgagagttgaaggaagttactggtggtagctggtgttggcacgagcaatggcacgaatgacagcgccagtgrtggccggtggctaggttggaggtgacccttgagaagggagaacaagaggagataaccatgaaagctagagtttgcggaaagagctcatgactacgaaaggtcgacgacaagtttagacatcactatcccactcattttttcgtgctctacgcaatggaccgagcrgaatcgcattttggggtaaggttttgttgaccttcttctacccatcaaactattttgatgtgttctcttagaaaccttatccatttgaatttcttgagttgtgagttgac

SEQ ID NO: 563 - DNA, 401 bp, Artificial Sequence
  Consensus Reference Sequence
gacatcactatcccactcattttttcgtgctctacgcaatggaccgagcrgaatcgcattttggggtaaggttttgttgaccttcttctacccatcaaactattttgatgtgttctcttagaaaccttatccatttgaatttcttgagttgtgagttgacttggtttgatttgaaaatgtaaaattgattgaaaagtcttaaaaatcgttagtgaggacctcttcaccttagatcttcacgagtgacgaagtcatagtgacaaatccataaggtatagaagaaactataatgagttgtgtgaaaacgcagaggaatgttgaagaatgattctttgatgcccaagggaccaagaaaaatagagaaacaaaaagattaaaaccatgcaataaaatgacatcat

SEQ ID NO: 564 - DNA, 401 bp, Artificial Sequence
  Consensus Reference Sequence
gcacctccaatccactctagtagctatatctccggtgatcaaggagatagaacagcaaaacaacgagttgaagcttccaaaggaggaacttcaatcgtttatcagaaagatggaggaggggacacmgcttgttttcgagtgttcaaaaatccggtggctacactttgtgactagggcttgttacaaggacaaactggaccagttttccgacgagctcgtgaaactatttgccatcgacatgcaagctcagatggcaagagatckgaaggagaccttgcttaaagttaggagaatamttagggttgttgagaaaacgtgcttcgaccctgggraggcaattgacaacacagtgttaaggtttttgacgtggatttctgtctttgctgtgaagctaataaggg

SEQ ID NO: 565 - DNA, 401 bp, Artificial Sequence
  Consensus Reference Sequence
gcaagagatckgaaggagaccttgcttaaagttaggagaatamttagggttgttgagaaaacgtgcttcgaccctgggraggcaattgacaacacagtgttaaggtttttgacgtggatttctgtctttgctgtgaagctaataagggtaatttctgctttgagatggatttttctgacgctaataagggtagcttttacattttcttccactaaacaggagcarttttcacttgataaacaattgaagagraaaaaaggctacttgctctctgccaggagtctcacaattttttgaactgttycaggggtcaggtaattatttcttgttttctaattaattagaaaattgtgccaatatgtttatttggttcaattactccgttacttgaattcttatat

SEQ ID NO: 566 - DNA, 401 bp, Artificial Sequence
  Consensus Reference Sequence
ggtttttgacgtggatttctgtctttgctgtgaagctaataagggtaatttctgctttgagatggatttttctgacgctaataagggtagcttttacrttttcttccactaaacaggagcarttttcacttgataaacaattgaagagraaaaaaggctacttgctctctgccaggagtctcacaattttttgaactgttccaggggtcaggtaattatttcttgttttctaattaattagaaaattgtgccaatatgtttatttggttcaattactccgttacttgaattcttatatgttgatttttttaaaataaaaatacgatttaagagatataaataattttcatgattgaagagttttttataataattgttgtaattgaaaagtagtttctagt

SEQ ID NO: 567 - DNA, 401 bp, Artificial Sequence
  Consensus Reference Sequence
ccattgtccttaagatattgatttaagatcgaaactaagaaaaaaaagtatttgttacgaaaatcataaagagaacataaggacactggttagcatttttcaataaacttgttagaacttgcgagaagaaagaagaagggaagaagggaaatatgctaagctaatactgggaatgagtttctctgctttattcatgagtgaacttgttcttttatacatggttccatatgacagtggcctattatggcctgcaactaccccgcaataacagaatarcggtctattctaaccaactaactatattctaactaactgggtacgtctgcatggcttctgcatgagtgcttcttatacgtagtcctcgaggtgtttaggacgtgagacttcccttcgtggtcatg

SEQ ID NO: 568 - DNA, 401 bp, Artificial Sequence
  Consensus Reference Sequence
cataaggacactggttagcatttttcaataaacttgttagaacttgcgagaagaaagaagaagggaagaagggaaatatgctaagctaatactgggaatgagtttctctgctttattcatgagtgracttgttcttttatacatggttccatatgacagtggcctattatggcctgcaactaccccgcaataacagaataacggtctattctaaccaactaactatattctaactaactgggtacgtctgcatggcttctgcatgagtgcttcttatacgtagtcctcgaggtgtttaggacgtgagacttcccttcgtggtcatgccatcggaacggtgctaacaaaacttttgcatttatactacttaatatgtgtgtagcttttcttaaggaaaaaaa

SEQ ID NO: 569 - DNA, 401 bp, Artificial Sequence
  Consensus Reference Sequence
aaagggttgcctgcatgaataaaacgggagaatattttgagaaaagcttagtttagtatgagggaccttgacctcgaaccaaggtataccatcttcttcctctctgctctcaaaaactggtccgacctgcccttttccatggcagagcatggaacctgccgcaccactacagatcacctcgaggaagccattgctrccctcaccgagaaacattccaacttggccaacaagttcgaggccatgtgcgagcgtctctctcacatgtcttctactgcgccaccgcctcctcagatccctcggccaccggtcaagctcgacgttccacgttttgatgaccatgacccgcttggatggatcttcaaaatttctcagttcttcgactaccaaggaactccagaaga

SEQ ID NO: 570 - DNA, 401 bp, Artificial Sequence
  Consensus Reference Sequence
atttctcagttcttcgactaccaaggaactccagaagaggatcgaatcatggtagcttcattctaccttgatggccccgcactcagctagtttcagtggatgtttaggaacggattcatcacttcgtggccagctctcctccaagcaatcgaatcccacttcgctccctcgatctacaacgacccccacgaagctttgttcaagctgattcaacgaggtatagtaacggagtacctaacggaatttgagaagctagcgaatcstatcaccagactgtcatcgtcggttctcctcagctgtttcatctccggcctgagtcygaaatatgtcgtgaggtacaagctttccatcctgtatctttacctaaagctacagctcttgctcgtcttcaggaagacaaa

SEQ ID NO: 571 - DNA, 401 bp, Artificial Sequence
  Consensus Reference Sequence
ctaccttgatggccccgcactcagctagtttcagtggatgtttaggaacggattcatcacttcgtggccagctctcctccaagcaatcgaatcccacttcgctccctcgatctacaacgacccccacgaagctttgttsaagctgattcaacgaggtatagtaacggagtacctaacggaatttgagaagctagcgaatcctatcaccagactgtcatcgtcggttctcctcagctgtttcatctccggcctgagtcygaaatatgtcgtgaggtacaagctttccatcctgtatctttacctaaagctacagctcttgctcgtcttcaggaagacaaaattaacgatcaycggaaacacgtccggtcctcgtttggccacccaccaccaagtaacaccac

SEQ ID NO: 572 - DNA, 401 bp, Artificial Sequence
  Consensus Reference Sequence
cacttcgtggccagctctcctccaagcaatcgaatcccacttcgctccctcgatctacaacgacccccacgaagctttgttsaagctgattcaacgaggtatagtaacggagtacctaacggaatttgagaagctagcgaatcstatcaccagactgtcatcgtcggttctcctcagctgtttcatctccggcctgagtccgaaatatgtcgtgaggtacaagctttccatcctgtatctttacctaaagctacagctcttgctcgtcttcaggaagacaaaattaacgatcaycggaaacacgtccggtcctcgtttggccacccaccaccaagtaacaccaccccctctaaccctcacactacccagacagctcgaccgaaacccccttttgtccaaag

SEQ ID NO: 573 - DNA, 401 bp, Artificial Sequence
  Consensus Reference Sequence
atccttccataaccgaacttgacccaatcatagatgaccccarccagcttttcgatccaacctcgcttcaacctcatataagtctccacgccatggctggcgtgccggccacggataccttcagactatacgggcttatcaacaacactcgcgtcaccatactagtggacarcggcaacactcataacttcgttcaaccccgtgttacgaagttcctcaatttacccatgcaagataggatgcctctcagagtgatggtgggcaatggctctattttggactgycrgcaattgtgccctgataccaagatactcatccaggatcacacttttgttgtcaccttgcgcgtcttgctgttaagtggaaccracgttgttttgggtgtggaatggttacgtacg

SEQ ID NO: 574 - DNA, 401 bp, Artificial Sequence
  Consensus Reference Sequence
ccacgccatggctggcgtgccggccacggataccttcagactatacgggcttatcaacaacactcgcgtcaccatactagtggacarcggcaacactcataacttcgttcaacccygtgttacgaagttcctcaatttacccatgcaagataggatgcctctcagagtgatggtgggcaatggctctattttggactgycagcaattgtgccctgataccaagatactcatccaggatcacacttttgttgtcaccttgcgcgtcttgctgttaagtggaaccracgttgttttgggtgtggaatggttacgtacgwtgggcccaatcgttactgattacaccgcttttactatgcagttcaccttttttggcaggcccattaatctcctcgctaatgttc

SEQ ID NO: 575 - DNA, 401 bp, Artificial Sequence
  Consensus Reference Sequence
acarcggcaacactcataacttcgttcaacccygtgttacgaagttcctcaatttacccatgcaagataggatgcctctcagagtgatggtgggcaatggctctattttggactgycrgcaattgtgccctgataccaagatactcatccaggatcacacttttgttgtcaccttgcgcgtcttgctgttaagtggaaccaacgttgttttgggtgtggaatggttacgtacgwtgggcccaatcgttactgattacaccgcttttactatgcagttcaccttttttggcaggcccattaatctcctcgctaatgttcaagtggatacctacccagtctcggcccatcaggtgaagcgcttgatcaccactaactccacttcgggtttatttcacttatca

SEQ ID NO: 576 - DNA, 401 bp, Artificial Sequence
  Consensus Reference Sequence
gtgttacgaagttcctcaatttacccatgcaagataggatgcctctcagagtgatggtgggcaatggctctattttggactgycrgcaattgtgccctgataccaagatactcatccaggatcacacttttgttgtcaccttgcgcgtcttgctgttaagtggaaccracgttgttttgggtgtggaatggttacgtacgatgggcccaatcgttactgattacaccgcttttactatgcagttcaccttttttggcaggcccattaatctcctcgctaatgttcaagtggatacctacccagtctcggcccatcaggtgaagcgcttgatcaccactaactccacttcgggtttatttcacttatcacttctacccatccctcaacccgaaacagcgagc

SEQ ID NO: 577 - DNA, 401 bp, Artificial Sequence
  Consensus Reference Sequence
gcatcgtggttttcaaaactagacttaagacagggcttccatcagaatttaatggcggaaagggatatcccaaaaacaamctttcgaactcatcagggacattatgagtatagagtcatgcctttcggcctgtgctacgygccgtcgacgtttcaagtagccatgaacaccytgctaagtccgttcttaaggaaattcacagcagttttctttgacgacatactcgtctatagtgcaactcttccagatcaccttcaccacttggaatgcatctttaactccctgtcccaagctyagtatttcctcaagcgttccaaatgtttattcggacaacgtcagctcgattacttagggcacgtcatctccgacaagggtgtgcaaccagacccttctaagattca

SEQ ID NO: 578 - DNA, 401 bp, Artificial Sequence
  Consensus Reference Sequence
agggacattatgagtatagagtcatgcctttcggcctgtgctacgygccgtcgacgtttcaagtagccatgaacaccytgctaagtccgttcttaaggaaattcacrgcagttttctttgacgacatactcgtctatagtgcaactcttccagatcaccttcaccacttggaatgcatctttaactccctgtcccaagctcagtatttcctcaagcgttccaaatgtttattcggacaacgtcagctcgattacttagggcacgtcatctccgacaagggtgtgcaaccagacccttctaagattcaggccattattgactggcccaaccctcgctccccaaaggatcttcgcactttcctcggtctcactgggttttacaggaaatttgtgaaaggctat

SEQ ID NO: 579 - DNA, 401 bp, Artificial Sequence
  Consensus Reference Sequence
ccccaaaggatcttcgcactttcctcggtctcactgggttttacaggaaatttgtgaaaggctatgtagccattgcagcaccattgacaaagctcctttgtaaagatgccttcaaatggatactagattcttaggyggcgtttgacaacctgaaaaaggccatgatggtcgcaccggtattagctctccctgatttcacactgccttttkccctagaaacagacgcatccaactatgctatgggagtcgtcctacatcaacacggccaccctatagyattctttagtaagccattctgccagcgcctccaacatgmatctgcgtacgtccgtgagttacacgccatcgtcgccgccgtccgcaaatggcrgaagtatctactgggtcacagattcaccatc

SEQ ID NO: 580 - DNA, 401 bp, Artificial Sequence
  Consensus Reference Sequence
atggatactagattcttaggyggcgtttgacaacctgaaaaaggccatgatggtcgcaccggtattagctctccctgatttcacaytgccttttkccctagaaacagacgcatccaactatgctatgggagtcgtcctacatcaacacggccaccctatagyattctttagtaagccattctgccagcgcctccaacatgaatctgcgtacgtccgtgagttacacgccatcgtcgccgccgtccgcaaatggcrgaagtatctactgggtcacagattcaccatcttcacagaccatcgcaatctctgtgagctcatgtctcaaactatccagaccccaaaacagtagttctacctggccaagttacttgggtttgactacgacattcagtataaagcag

SEQ ID NO: 581 - DNA, 401 bp, Artificial Sequence
  Consensus Reference Sequence
cgtccgtgagttacacgccatcgtcgccgccgtccgcaaatggcrgaagtatctactgggtcacagattcaccatcttcacagaccatcgcaatctctgtgagctcatgtctcaaactatccagaccccaaaacagtagttctacctggccaagttacttgggtttgactacgacattcagtataaagcaggaacatcgaacgtggttgctgactctctttcgcgcatagataactcagctcagggacagtacctcgtcctgtctgttcctcaccacgagttcatgcttcaactaaaagaatccttatcagccagctcggagttccaaaagcaacgtgagaccatacaagctgagcctgcagaccatcccgatttctcaatctcaagtgatttcatccttt

SEQ ID NO: 582 - DNA, 401 bp, Artificial Sequence
  Consensus Reference Sequence
gttcatgcttcaactaaaagaatccttatcagccagctcggagttccaaaagcaacgtgagaccatacaagctgagcctgcagaccatcccgatttctcaatctcaagtgatttcatccttttcaaggatgcaatttggattgatgcccagaacccattcatcccagcactgctacatgagtatcatgctgcccctctcrcgggccatttcggtgtgaagaagatgttccatcgcctccgttccaactttcaatgggccagcatgctcaaagacgttaagacattcgttcgcaactgcagtacatgtcaacaggtaaaatcggtcacgcagaaaagtgctggtctgttgcaacctattccgatacccaccgacatytgggaagatctctccatggatttca

SEQ ID NO: 583 - DNA, 401 bp, Artificial Sequence
  Consensus Reference Sequence
catgagtatcatgctgcccctctcrygggccatttcggtgtgaagaagatgttccatcgcctccgttccaactttcaatgggccagcatgctcaaagacgttaagacattcgttcgcaactgcagtacatgtcaacaggtaaaatcggtcacgcagaaaagtgctggtctgttgcaacctattccgatacccaccgacatctgggaagatctctccatggatttcatcacacaccttccaagctcccatgggttcacaactatccttgtggttgtagataggttctmtaaaggggttcaccttggcgccctaccttctcactatacggcattcaaaatggctaacctcttcgtcagtatggtatgcaagctgcacgggtttcctcctagcctcattctrac

SEQ ID NO: 584 - DNA, 401 bp, Artificial Sequence
  Consensus Reference Sequence
aaaytgtgttcctggagtgtacaaacttgttgtgcaggtttcacatcgataagaatgtcaaggccaagtgcaaatctttaatcggtcaaaaaaatgtctagractatgtgatggataactggggtactttggttgattgtccatccgaacaacaatttkctgagtcccttcacaagtttcaaattgcttgttcaccttgaccaatgttcgttgactatgttaagacacatggattatcccacacaaggaaaaatttattacagcctggacgaataaggtcatgcacctaggcaacacaacaacaaacaggtattaaattttttttttctagtcaggattattaataaatggtatttaattgttgtatatttttcatgtttgttgtgtattttaaatgtaag

SEQ ID NO: 585 - DNA, 401 bp, Artificial Sequence
  Consensus Reference Sequence
tccaaaacttggcttaaggaccgggatcagaatcagaatcggtgtgtcatatagagtgcataaaaagtaaactatattawacaaaaagtgtaacaaatacaaaaaatgatgtcagctataaaacataaaagacatcatcaatgctctgtgcrccgtctttgtcgagccctaacacttccatctgcgctggcaccccccatggcgatcctgagcaatcttgcatgatatcatgtaactttatgcctgcagtgaccatcctaaggttgagcacacaccccaacctttctacgatcgtttcatagccttcrtaatcatcccgtgacagtcatgaaaaacatttattacaaaatttaaaataaataacaattcataaaacattaaacgtgcaacttatcttacca

SEQ ID NO: 586 - DNA, 401 bp, Artificial Sequence
  Consensus Reference Sequence
ccagcgyggtagctccccaggcatagcccccactctgacccaggtcgcgaaaagcctctagatgcaccacatgaatatttgttgcacttttgttagaaaaaagagtrmaaccgaccaggtgcaggagataagcacgagctrctacaatccatcgtcgtgtctggcatctcgtctcatagatctcccgaacccatgacaggcgtacatatgccccaggcactcatactatctcggctctagcctcctcaccggacacctcaagcaactccatcaacaaaaatattgtctygtccacagaaagagcctcgtagctgtggaaggcgccactaataggcagatggaggagygacgacmcatcatccagtgtgatcrtcaactctccyactggaargtggaaggtg

SEQ ID NO: 587 - DNA, 401 bp, Artificial Sequence
  Consensus Reference Sequence
gattcttatctttaaggagcaagttagttttaatattctgwtttgctaatatcttgttatctaattagtttatcttttgctatttattgtatcgcyactgagaacaatttgaatyakaatagaataattctatttcytctgcatacgtattgtctttcttctctcctctgttttttttataatttcctcctcaaaaccaacaattggtatcgagagccttattcttacgggacctctaccatggaaggtgaarcaagtttttcccacataactctyccaatctttgatggagagaattatgatmtttgggaagtgaaaatgcaatcctacatggagtmtttggatttgtgggatgctgtggaagaggattatgaaatatttccgctgcctgaaaatcccac

SEQ ID NO: 588 - DNA, 401 bp, Artificial Sequence
  Consensus Reference Sequence
tctgcatacgtattgtctttcttctctcctctgttttttttataatttcctcctcaaaaccaayaattggtatcgagagccttattcttacgggacctctaccatggaaggtgaarcaagtttttcccacataactctyccaatctttgatggagagaattatgatmtttgggaagtgaaaatgcaatcctacatggagtatttggatttgtgggatgctgtggaagaggattatgaaatatttccgctgcctgaaaatcccaccatgrcccaaattaaaaatcacaaggaaagaaagatgaagaaggcaaaggcgagatsatgtttgttcactggtgtttcacaaatgatattcatcakaatcatgactcttaaatcacccaaaacaatttggaattatc

SEQ ID NO: 589 - DNA, 401 bp, Artificial Sequence
  Consensus Reference Sequence
ttatgatmtttgggaagtgaaaatgcaatcctacatggagtmtttggatttgtgggatgctgtggaagaggattatgaaatatttccgctgcctgaaaatcccaccatgrcccaaattaaaaatcacaaggaaagaaagatgaagaaggcaaaggcgagatsatgtttgttcactggtgtttcacaaatgatattcatcagaatcatgactcttaaatcacccaaaacaatttggaattatctgaaagaggaatacgctggagatgatagaatacgaarcatgcaagtgctraatttaaggagggaatttgagcttcaaaggatgcaagagtcagagacaatcaaagaatactcaaacaaattgttgggtattgccaacaagataaagttgttgggaagcg

SEQ ID NO: 590 - DNA, 401 bp, Artificial Sequence
  Consensus Reference Sequence
ctaatcaagaagaagagkaycaactgtttgtggyyacatgcttcttgagtagtgaatcaagkgaaagttggttgattgatagtggttgtaygaaccacatgamatatgataagactctattcaaggwtttgaagccaactaatgtctcaaaggtcagaattgggaatggtggctatattcctgtaaaaggaaaaggaactattgcaatttcaacgtgttcagcagaggaggagcatacaaccyatttcactcaagtcacacccacrgaattcaagcacaagasacttgatcattgccatcttgaaagaatgctaaacatgaaaaaaaggaaatatgcaaaaraaaatttgaagaagtttcaaatggaggaatrcaaatctgttagcactccaatgaatcaa

SEQ ID NO: 591 - DNA, 401 bp, Artificial Sequence
  Consensus Reference Sequence
tcttgagtagtgaatcaagkgaaagttggttgattgatagtggttgtaygaaccacatgamatatgataagactctattcaaggwtttgaagccaactaatgtctcaaaggtcagaattgggaatggtggctatattcctgtaaaaggaaaaggaactrttgcaatttcaacgtgttcagcagaggaggagcatacaacccatttcactcaagtcacacccacrgaattcaagcacaagasacttgatcattgccatcttgaaagaatgctaaacatgaaaaaaaggaaatatgcaaaaraaaatttgaagaagtttcaaatggaggaatrcaaatctgttagcactccaatgaatcaaaakgagaagttcagcaagaaaraaggtgttgataacattgat

SEQ ID NO: 592 - DNA, 401 bp, Artificial Sequence
  Consensus Reference Sequence
aatatgcaaaaraaaatttgaagaagtttcaaatggaggaatrcaaatctgttagcactccaatgaatcaaaakgagaagttcagcaagaaaraaggtgttgataacattgatgaaggatattatgrgagcttgattggatrtctaatgtatctcacttcaacaaggtcaaayattctatttgctcaaaagaacaaaactagaatttttgttgacaatcaagtagycattgctattgcaaacaatcycgtgtgtcatgaraagactaaacatttcaacatcaagttctattatttgataaagatgcaacaaagtgrtgaagtgaacttaatttattktaagtctaaagatcaaytgrctgacatgtttayaaagtcaytacctatcaacaaayttgaactc

SEQ ID NO: 593 - DNA, 401 bp, Artificial Sequence
  Consensus Reference Sequence
aggaacatcctcagtcacctgagaaacaccctcatcaaccgcaatatgtacccgttgcctatgggctgatgcagtaggcctacgcctccaggtaacatcaactrcatcatgctcatcctgtctacctctgcctataaccctagctaaagcacracctaaacctcgtgttctaaccatgatctacaaatcatgaagaacacatatttttttggktcaaataaactattcatataattaaaaacctacatatatttacataaatcttcakccttacgtaataaaccctaatcacactaccctaagctttgttgactaccctaaactaaaccccacacactcaaccactaaacaaaaatataaaaaaataaatataaaaaacaaaaatttaacctaatatataa

SEQ ID NO: 594 - DNA, 401 bp, Artificial Sequence
  Consensus Reference Sequence
gatgcagtaggcctacgcctccaggtaacatcaactrcatcatgctcatcctgtctacctctgcctataaccctagctaaagcacracctaaacctcgtgttctaaccatgatctacaaatcatgaagaacacrtatttttttggktcaaataaactattcatataattaaaaacctacatatatttacataaatcttcagccttacgtaataaaccctaatcacactaccctaagctttgttgactaccctaaactaaaccccacacactcaaccactaaacaaaaatataaaaaaataaatataaaaaacaaaaatttaacctaatatataatatttaagtaattttttttacataccaccatgcaagcataaatatttctattattacaaaacaaaat

SEQ ID NO: 595 - DNA, 401 bp, Artificial Sequence
  Consensus Reference Sequence
aaacgtagcaacggcaccacaaaagctttgaaaacgaacggaaatgttaaaaaattataaaccagctaatgatagaagctctttcatattagttttttcaaaagataatttttaaattataaactcacattaacttatagaaaagtttatttatttattttttctttttatattctttttttagtagtaattctaaatacatttatccaaatagacccttattattaatatatatcaacaatacttacatccaaattatcacttaatcaagccttgaaattattttatataaaataatcagattaattaaccaattacgtgcttggttttcattyataaaatcaatattagtaattatttagaaattttaaaaaattattcagtcatatgtcataatctat

SEQ ID NO: 596 - DNA, 401 bp, Artificial Sequence
  Consensus Reference Sequence
ttatagaaaagtttatttatttattttttctttttatattctttttttagtagtaattctaaatacrtttatccaaatagacccttattattaatatatatcaacaatacttacatccaaattatcacttaatcaagccttgaaattattttatataaaataatcagattaattaaccaattacgtgcttggttttcattcataaaatcaatattagtaattatttagaaattttaaaaaattattcagtcatatgtcataatctattatatataataagtttattaatttttaaaataaatatrataaagtaattcaaataatatgatttatgattgaaatgatgttcatatcatatgggtataaacattaaactcaattactaatcaactggtatggtc

SEQ ID NO: 597 - DNA, 401 bp, Artificial Sequence
  Consensus Reference Sequence
aagrtaaggataaaaagaaaaattatccaccttgtcatcattgtggcaaaaaaggtcatgcacctttcaratgttggaggagaccaratgcaawatrtaacaagtgcaacyagataggrcatgaagckgtgatcygcsccaacaaaaatcaccatgatgagggagctcagattgctaatcaagaagaagaggaccaactrattgtggccacatgcttcttgagtagtgaatcaagtgaaarttggttgattgatagtrgttgtacgaaccacatgacatatgataagactytattcaaagatttgaagccaactartgtctcaaaggttagaattgggaatgrtggctatattcmwrtaaamggaaaaggaactrttgcaatttcracgtgttcaggtatc

SEQ ID NO: 598 - DNA, 401 bp, Artificial Sequence
  Consensus Reference Sequence
atgagggagctcagattgctaatcaagaagaagaggaccaactrwttgtggccacatgcttcttgagtagtgaatcaagtgaaarttggttgattgatagtrgttgtacgaaccacatgacatatgataagactytattcaaagatttgaagccaactartgtctcaaaggttagaattgggaatgrtggctatattcmwataaamggaaaaggaactrttgcaatttcracgtgttcaggtatcaaattaatatcagatgttctttatgtacctaacattgamcaaaacttgctaagtktaggtcaattgattaaaaagggatttaaagtgtcctttgaacatcaacattgctttatctatgacaattttggccgagaagttttaagggttaaaatgaaa

SEQ ID NO: 599 - DNA, 401 bp, Artificial Sequence
  Consensus Reference Sequence
taaagtgtcctttgaacatcaacattgctttatctatgacaattttggccgagaagttttaagggttaaaatgaaaggtaaaagcttctcatttgatccagtagaggaggagcataacacctatttcactcaagtcacacccacggaactctggcacaagagacttgatcattgtcatcttgaaagaatgctaaacatgaaaaaaaggaaatatgcaaaagaaaatttgaaaaartttcaaatggaagaatgcaagtctgttagcacacyaatgaatcaaaakgagaagttcagcaagaaaraagrtrttgataacattgatgaaggatattrtgrgagcttgattgrrtgtctaatgtatctcacttcaacaaggtcaaayattctatttgctcaaaaga

SEQ ID NO: 600 - DNA, 401 bp, Artificial Sequence
  Consensus Reference Sequence
tatgacaattttggccgagaagttttaagggttaaaatgaaaggtaaaagcttctcatttgatccagtagaggaggagcataacacctatttcactcaagtcacacccacggaactctggcacaagagacttgatcattgtcatcttgaaagaatgctaaacatgaraaaaaggaaatatgcaaaagaaaatttgaaaaaatttcaaatggaagaatgcaagtctgttagcacacyaatgaatcaaaakgagaagttcagcaagaaaraagrtrttgataacattgatgaaggatattrtgrgagcttgattgrrtgtctaatgtatctcacttcaacaaggtcaaayattctatttgctcaaaagaamaaaaytgaaatttttgttgacaatcaagtagc

SEQ ID NO: 601 - DNA, 401 bp, Artificial Sequence
  Consensus Reference Sequence
tgcagttccaaaagcaaggaggagtgttgaagatatacttttgtaactgcatamtatttkatttttcaatttttaaaataggatttagtaaataagttgattccctataytttaggagtaaggcagttttaatggattagcmtagtcaaataagtggttcttatctttaaggagcaagttagttttaatattmtgttttgctaatatcttgttatctaattagtttatcttttkytatttattgtatcrctgctgaraayaatttgrattagaataraataattctatttcctctgcatayrtattgtctctcttctctcmtctgttttttatagtttcctccacaaaaccaacatgcttttatatgtgtcataatagagcagtagatttccacccctcca

SEQ ID NO: 602 - DNA, 401 bp, Artificial Sequence
  Consensus Reference Sequence
ttatcacgttggcctggatgctttttgggagtctctttacttttgttycccacatgctgcttttttkatatttctattttgaatttagctcctccagactaaagactcaagagatttaaagagtgatgatatttctaccattaattttaaaaaaaatggattatatttctaaaatgattttaattaaagttagtgatggccagctttctygctttaaatgtcacctcactttagactagtttcatttctgyttccaaaccgtgtggascagtggtgtatgtttttttctttcttttctgaaattgcttgcaggtttcacaaaacactgatcccttttctttgtgatatktatggatggctrcaaggktactgtgcgtatttaagttcctgtctttaatggt

SEQ ID NO: 603 - DNA, 401 bp, Artificial Sequence
  Consensus Reference Sequence
ttctaaaatgattttaattaaagttagtgatggcsagctttctygctttaaatgtcacctcactttagactagtttcatttctgyttccaaaccgtgtggascagtggtgtatgtttttttctttcttttctgaaattgcttgcaggtttcacaaaacactgatcccttttctttgtgatatktatggatggctrcaagggtactgtgcgtatttaagttcctgtctttaatggtctgtaagacaagttgtattaaagcakattgtacatgtgtttstatgaacrgtacaaaagttgatttcacaaatctaatttatatttggatatttctattttaaaaataagttagtagtaaaattgcaaatgaatttttttggtgtaatccaaaagttacctaaaaa

SEQ ID NO: 604 - DNA, 401 bp, Artificial Sequence
  Consensus Reference Sequence
caaaagttacctaaaaatacttaactaagaattagttctaaatttaaaatttaaaatcaatttctcactgtgaaagtaaatagttgaacatttactcaaattcatgttagtttatatttcaacataattttagaaaatcaagcataaaatctaatatayacgattaaaattrtcatagagatgtgttgttttagaaagatctaataacgaattaatcatgatctcataaacaattgatattagtagtagtagtttgtatttcttaatcaagtgttaaacaaatattaaaccaaaacaaaaaaaagtattgaacaaataaaaagaaagaattgaacaaaggacacatgctaattgatccctaataacataatattaaccaattcaagagtttaatatgtcct

SEQ ID NO: 605 - DNA, 401 bp, Artificial Sequence
  Consensus Reference Sequence
aattaacagataaataaatttatgatatttttttttacttttaaaactaaaattttaattttagtctttaaagacaaacttgtcaacactaaaacataagaagaaaatagttattaaaaaataaaaatgaaagatctttactcatgattcaatgattcgagtcttacccgcgtgaaccctgattctgaatctggaacagyagtctccgtccgatcgacatgtaaggtacgaccacgaatcagtaactgacacrtgtcttatcattcgtgcagatgtcatctgtatatagagcacaacacgggaagacgttaactggytggtactgcgaatattcatccgccactggtgccatctgattggatgaccttgctaccagtcacgggaagagcccatcttgtggt

SEQ ID NO: 606 - DNA, 401 bp, Artificial Sequence
  Consensus Reference Sequence
aaaaataaaaatgaaagatctttactcatgattcaatgattcgagtcttacccgcgtgaaccctgattctgaatctggaacagyrgtctccgtccgatcgacatgtaaggtacgaccacgaatcagtaactgacacrtgtcttatcattcgtgcagatgtcatctgtatatagagcacaacacgggaagacgttaactggctggtactgcgaatattcatccgccactggtgccatctgattggatgaccttgctaccagtcacgggaagagcccatcttgtggttaggtgttgaasgatgtttggcatascatcattttcattgtccctaattctcaccaatctcacaccyaaaagattttgtyactttgtaacaagggarctgctactaagatttaata

SEQ ID NO: 607 - DNA, 401 bp, Artificial Sequence
  Consensus Reference Sequence
ttttatttaatatttawraatatttytataatttaaacccatgcattaartataaagtaattttatattattattcactcatatatcatcattaatataatttttaagatattatagatgataaaataataatgaatgaagttttaaattagatttacacttttattatataacttattttttctatttattaastagacattacttttatagccccatttsttgtcytatttctcactcccacatctaagttaactttgttttttcttycttgaatgttgtcacattgtaacaagtggaattrttaagatttttaaaaaagcaawttgtttsaatgataaattaaattttaaacaattttaatattctaatattatatttttatttaatatttttaattt

SEQ ID NO: 608 - DNA, 401 bp, Artificial Sequence
  Consensus Reference Sequence
actttgttttttcttycttgaatgttgtcacattgtaacaagtggaattrttaagatttttaaaaaagcaawttgtttsaatgataaattaaattttaaacaattttaatattctaatattatatttttatttaatatttttaatttttaagttttcttagtatttaagaatatttattaacaagaccttttatagctatattttttatggaatgactactttttttagtaatgagaattttgcattgatgacgattaacttaagttcaagtgaagcvattgtatgcatgagtgcaaattarcttatttagttkaccarayttttcttataattcacaaaggttgttayaaaaattmaatgtatctaatttaagtatatyaatgcattaaaatctayttat

SEQ ID NO: 609 - DNA, 401 bp, Artificial Sequence
  Consensus Reference Sequence
actataataatwggtctttaaaatgattaaacacatgcttgagacaacatytttatatgctaayaatgtgggtttgaraaacagcttagaagttagaactagaaggtgttakaatattctcttatkctyttatttattaaacttgacarcaactyytgtcttttcttccttcttcttagttataacrcctatatcatcatcattcctctcattgcaccataaaacaaagaacataaaggccttgcaggtaaattgagatttacccatttcaattttcctctatatgttatattttttttttatcttcattcttatttgaaaattttgaaatctggattcatttttttccttcaaggtttttaaacttttctattttattattgtgggctttaaagtgatta

SEQ ID NO: 610 - DNA, 401 bp, Artificial Sequence
  Consensus Reference Sequence
aggtttttaaacttttctattttattattgtgggctttaaagtgattatttttctttctaaattgtctctatttctctctgttggatgagaaatattggtcatcatggtgtagaagatttgaattttatgcttcttagttatttgtagtctattagcgtgtttggttttgtgagagtttaattctgttttgtgtggtgtaaatttaattgtacattggatataagagagtaacaaaattttaaaattctgttataagtgcctagcctgagtgtaaagggttgttgctttgttttgcttgtataaaaggacatacatacatcttaataacagagtgtgtgttgttttcattctatcatttttctgttgctagtgytattcctagtgtgtaggtgtgcaattc

SEQ ID NO: 611 - DNA, 401 bp, Artificial Sequence
  Consensus Reference Sequence
tgtagagaaggtgcttaraaccatgccacccaagttcraccatattgtggtagccattgaggaatccaaaaatcttgaagagcttagcctagaggaattgcaaggatctttggaatctcatgagcagagaatgaatgaaaggatcaatgagaagaaaagtgaacaagccttgcaagcatggtctaatccaaagaagcatgatgatagatggaagaaagagaaaactgaagcaaagaacaataaatggaggggaaatcagaacagtgataaggaccacaagaaaagagggggatccaattcccaaaactcttcaaatagaaagaagttmgataaaagaagtattcaatgctttaactrtcaaaagtttgggcactttgctgatgagtgttacagcaaaccma

SEQ ID NO: 612 - DNA, 401 bp, Artificial Sequence
  Consensus Reference Sequence
caaaaaatagaacatttaaaattgagattgatatgataaaaaagaagtgttttgccactacagtaaatagtgaagagtggttatggcattacagatttggccatttaaattttagagatctgattcagctaaacttaagagaaatggtgctgggtttgcctcagatcaaacctcctagtgaagtatgtgatggttgtttgcagtgtaagcaatcaagaagcactttcaaacaaaatgtaccaatcagggcaaaggagaaacttgaagtgatttactctgatgtgtgtggccctatgcagactgaatctcttggtggaaacagatacttcatatcctttattgatgaattgactaggaaagtatggrtttacctaataagaaggaagagtgatgtctttgaa

SEQ ID NO: 613 - DNA, 401 bp, Artificial Sequence
  Consensus Reference Sequence
gaagytatgacagaagagcttaaatctattgagaaaaatcaagtgtgggagctggtatctcaaccaaaatcgaagaagcccattgatgtgaagtggatctataagattaagacaaatctagaaggcaaggtggtcaagtataaagctagacttgtggctagaggatttttactgaaagctgggattgactacagagaggtatttgcaccagttgctagaattgagactattagaacagtagtggcaattgctagcctaaataattggacaatgcaccaactagatgtgaagtgtgctttcttaaatggtcctcttgataaggaggtctatgtgacacagccacctggattctctatagctrgccaagagtcaaaggttcttaaattgagaaaagctcttta

SEQ ID NO: 614 - DNA, 401 bp, Artificial Sequence
  Consensus Reference Sequence
cagcaactcagaggaattagtgggatatactgatgcagattggggaggagacagagatgacagaaagagtactacaggttacatattcatgtatggtrcagcaccaatatcgtggtgttctaagaagcaatccatagtggctttatcaacatgtgaagctgagtatgttgcagctgcaatgagtgcttgccaagctgtctagttggacacattattacaggaattaaaaatcaaggagagtgatggastgaagctttttgtggataataagtcakctataagcttgtcaaagaatccaacctctcatggtagaagcaaacacatagaaacaagrtttcactatcwtagggatcaagtgaacaaakagaaattgaaagtggagtattgctgcacatttgatc

SEQ ID NO: 615 - DNA, 401 bp, Artificial Sequence
  Consensus Reference Sequence
attgaaagtggagtattgctgcacatttgatcaacttgctgatattttaaccaaacccctcaaaggggagaggtttaaaatgttaagggacagaattggcttgatgaacttaggagatcagaattaagggagggtgtgagagtttaattctgttttgtgtggkgtagatttaattgtacattggatataagagagtaacaaaattttaaaattctgttataagtgcctagcctgagtgtaaagggttgttgctttgttttgcttgtataaaaggacatgcatacatyttaataatagagtgtgtgttgttttcattctatcatttttctgttgctagtgctattcctagtgtgtaggtgtgtaattctttgtttaaaaacagtgagtgatacgcgagtgaa

SEQ ID NO: 616 - DNA, 401 bp, Artificial Sequence
  Consensus Reference Sequence
tcttgttttgttcttyttggtcatgaatcgtttatttttaagaactctawaaacgactagactacctgagagaaatstaattgatgtgytaaatactttgttttttaatccagtcctgtttaaatatgatcaaaactcacctaatgccttatggtttcgggttaagcaccaagayggattactccacagtacatgtggtacccctgcctatgttgctccggaagtgataaacagaaggggttatgatggagccaaagctgatatatggtcatgtggggtgatcttgtatgttctattggcaggggagasttcaaatttcctaactggwttgcaccagatgtaygcagattgctgtcgaaaatcwtggaaagytcttggttcaaaagggggytagagaagcc

SEQ ID NO: 617 - DNA, 401 bp, Artificial Sequence
  Consensus Reference Sequence
ttgctccggaagtgataaacagaaggggttatgatggagccaaagctgatatatggtcatgtggggtgatcttgtatgttctattggcaggggagasttcaaatttcctaactggwttgcaccagatgtaygcagattgctgtcgaaaatcwtggaaagytcttggttcaaaagggggytagagaagcctaccattactcagaackaagaccaagaactggctcctctkgatgcattatttgtgaaaaaattgttttagtatgtaaaaaaatctcatatcacwttaaactttacagttaagactaagagaaatttataaatatttgatttctcaatctagcaagactttatttaataataacaaaatcatgacagaaattcaaagcgaaatatcaaagaat

SEQ ID NO: 618 - DNA, 401 bp, Artificial Sequence
  Consensus Reference Sequence
cttttaacacttaatttttttttattattaaattaattttatatctttrgatattttatttattattattaattattaaaagaaagtgcakagagtattgttagcatttctattattattaatctgaaattgaacaatgtatgtattcaacacaacatawctatgtatgtatttaatttgttttgttattgttttacgcaagtatttggaggtgactgaaatcgttagtgtgycctrgctaaaaatcctgggcaggatcaaaactrsratgttgtccccaaatacattgtacggggcataccttgtgtttaaagaaagcagtgatggtgcctacgggttcaagaacrtgcctgttgaggtgtccattggggttatcsgagaggttacagattcaagaatta

SEQ ID NO: 619 - DNA, 401 bp, Artificial Sequence
  Consensus Reference Sequence
  misc_feature 143, 333: n = A,T,C or G
acttaaggaatctagaataagacctccacaaaaagcttggttcgaggagggatagtaagaaccatccgtcttaactttaaaagcccctgcaggaggaggtactcgtgcttartcgccwactaacyctccatgcacccattaantgttccttcttcttaggcatagtctagtgtagtatgcgaccaactagggtatgatgactatgttggtgtagtagtgccataaggcgwggatatttatgctttcgasgctttgtgttgtaygtacaatgtatctcatggtrgcgtatctttgtttcrtagttggataktggttgcataacttacaaaaaantaacacatttttataagcaaattaatggagagttttcttataaaatggatcgtatacattatgttagt

SEQ ID NO: 620 - DNA, 401 bp, Artificial Sequence
  Consensus Reference Sequence
  misc_feature 114, 304: n = A,T,C or G
aaaaagcttggttcgaggagggatagtaagaaccatccgtcttaactttaaaagcccctgcaggaggaggtactcgtgcttartcgccwactaacyctccatgcacccattaantgttccttcttcttaggcatagtctagtgtagtatgcgaccaactagggtatgatgastatgttggtgtagtagtgccataaggcgaggatatttatgctttcgasgctttgtgttgtaygtacaatgtatctcatggtrgcgtatctttgtttcrtagttggataktggttgcataacttacaaaaaantaacacatttttataagcaaattaatggagagttttcttataaaatggatcgtatacattatgttagtataaagtaattacaggttggtaacttaat

SEQ ID NO: 621 - DNA, 401 bp, Artificial Sequence
  Consensus Reference Sequence
gcccgcctataaaccatartgcaagcttgatccttgatatatatatatatatatatatatatatatatatatatatatatatatatatatatatatagagagagagagagagagagagagagagagagagagagagagagagagagagagagagagaatcttctttcaccaattaatgatgccatgccaacacgtccaaacttttttgggactacactgtaacggtatgttttctatatacaattacaatgtattcccagctagctrggatatgtctgcaagttctttaatattttatgtttasattttcaagtwggtttttgtaaacaaaatctgaccagatcaaaatcaaatrgaactgcccttatatcgtggttaattttgagcttctgcttccyacc

SEQ ID NO: 622 - DNA, 401 bp, Artificial Sequence
  Consensus Reference Sequence
tcattatgtatggtaaatttattaacttttaaaataattataataaaataattcaaaatatatgatttatgattaaatgattatrtaaaattaatttatacaatatgtgacattaaactcaattactaatcaactcatggtggtcaataagcacataaagacgtagcsaagggacaaacaaaataaattaaaaacaatcaacacaactyttacgatcttayaaaagtcttcaaaccctaagcgtaaagtcctcgtcagtaatgcttgtcatgttttatctttcacaataaacgccggcaaaaatrtarctaaattaataaatcatgtttttctcaataattagcctctgcataataacttgrtgaataacyaaattaataataattatatacgtataattg

SEQ ID NO: 623 - DNA, 401 bp, Artificial Sequence
  Consensus Reference Sequence
cgtagcsaagggacaaacaaaataaattaaaaacaatcamcacaactyttacgatcttayaaaagtcttcaaaccctaagcgtaaagtcctcgtcagtaatgcttgtcatgttttatctttcacaataaacgccggcaaaaatrtarctaaattaataaatcatgtttttctcaataattagcctctgcataataacttgatgaataacyaaattaataataattatatacgtataattggcaaatcagcagaactttgcactcgacaaactgcascggaaaaaaaaaagttagatgctctctgcctagattctcttgattgcttggggaaacactcctagtggacttcggttccaaaggccaggwaataattagtataatcgtgtttttaatttttattt

SEQ ID NO: 624 - DNA, 401 bp, Artificial Sequence
  Consensus Reference Sequence
tttttctcaataattagcctctgcataataacttgrtgaataacyaaattaataataattatatacgtataattggcaaatcagcagaactttgcactcgacaaactgcascggaaaaaaaaaagttagatgctctctgcctagattctcttgattgcttggggaaacactcctagtggacttcggttccaaaggccaggaaataattagtataatcgtgtttttaatttttatttctttaaagtagttkattacattrgattagcggataaaaattaaaaatrtaatatacaaaaacacaaaatacacttaagcattgctccccyaaaattttcaagatttatatatatgtcctgcatattkgtgttttttaatttgcaatctaattttaaatttttaat

SEQ ID NO: 625 - DNA, 401 bp, Artificial Sequence
  Consensus Reference Sequence
ttagatgctctctgcctagattctcttgattgcttggggaaacactcctagtggacttcggttccaaaggccaggwaataattagtataatcgtgtttttaatttttatttctttaaagtagttkattacattrgattagcggataaaaattaaaaatrtaatatacaaaaacacaaaatacacttaagcattgctcccccaaaattttcaagatttatatatatgtcctgcatattkgtgttttttaatttgcaatctaattttaaatttttaatgtttaaagcttttgttcttttagaatcccagataatctcaactagcacagtgctcttattcacaggtatgtatacatatatgtgaagtgaccaattctttaaaaaaaaattatgataatcaaata

SEQ ID NO: 626 - DNA, 401 bp, Artificial Sequence
  Consensus Reference Sequence
ggaaacactcctagtggacttcggttccaaaggccaggwaataattagtataatcgtgtttttaatttttatttctttaaagtagttkattacattrgattagcggataaaaattaaaaatrtaatatacaaaaacacaaaatacacttaagcattgctccccyaaaattttcaagatttatatatatgtcctgcatattggtgttttttaatttgcaatctaattttaaatttttaatgtttaaagcttttgttcttttagaatcccagataatctcaactagcacagtgctcttattcacaggtatgtatacatatatgtgaagtgaccaattctttaaaaaaaaattatgataatcaaatatagtgacatrtaacatagaagtaagtataatatagwa

SEQ ID NO: 627 - DNA, 401 bp, Artificial Sequence
  Consensus Reference Sequence
tkgtgttttttaatttgcaatctaattttaaatttttaatgtttaaagcttttgttcttttagaatcccagataatctcaactagcacagtgctcttattcacaggtatgtatacatatatgtgaagtgaccaattctttaaaaaaaaattatgataatcaaatatagtgacatrtaacatagaagtaagtataatatagaaatataaaaagtattgtttcttgatgaaycaaatatgaaaattgttttgtttatagataatttcaagaaagaaatgagattgatcattgatagtaccattyttatttgtgatcaataggaaaaaatratctacaatttttttattttgtttttagcaatgtctaagaagtattttcacttgtacaccttttcatccttca

SEQ ID NO: 628 - DNA, 401 bp, Artificial Sequence
  Consensus Reference Sequence
araaataartttcccryrgtcattttcactctggcctcaataatmttaaggadaaattaagttagaatataacaayactgatgtgtaacatttttycggathattatatttaagtatttatcaatgttgttacttagtacctgyatcgttacttcttcgaaacatatatacaaggtcaatttccacgttgcctttgatracttgttgattctctgtagattcagtaacatatatacaaggtcaatttccatttcagaatgaattggatttagtaaaacgtaaaagkagaaagacatgaaatgaaacatatccttgacagaaatagttttstagttggttagacttrgaagatacctgttgrtcatccttggtggctaaatccatctatcrtcaaccykaat

SEQ ID NO: 629 - DNA, 401 bp, Artificial Sequence
  Consensus Reference Sequence
ttgacagaaatagttttstagttggttagacttrgaagatacctgttgrtcatccttggtggctaaatccatctatcrtcaaccykaatgccagggatgtggsaaattttaggccaaatttgagggtgcttcatgcggcatcktttttccagcaaaggacatctctytatggttaattttattagagagwcaggaagcctgtctcccaccatattytccagcaaaggacaactchbtatggttaattbttgcagggatgygagatggagaagccccgtgcagtccaacatctccagatttgacaagtcmywtagatacagagamgtaagggagggaggcagcaaaccctccttagggaakgacttgatrccatcacatsgaccccmaacastgagatgrgt

SEQ ID NO: 630 - DNA, 401 bp, Artificial Sequence
  Consensus Reference Sequence
agggatgygagatggagaagccccgtgcagtccaacatctccagatttgacaagtcmywtagatacagagamgtaagggagggaggcagcaaaccctccttagggaakgacttgatrccatcacatsgaccccmaacastgagatgrgtaagcatgcccatggatggccatgctaggccgctcagtagtttckcacaattcwmaatcbvaactgttctcaggttaggtggcatacccccttytggaaasgactcaatttctgggcagttggatatgwsgagatrttctaactttgggagaagastactcatctcatcaggyaacgacttcaacttgtcagagcccgcaacgatgaacttaagcaagttgggcgcaggcaatccttctccccagaatgatac

SEQ ID NO: 631 - DNA, 401 bp, Artificial Sequence
  Consensus Reference Sequence
aaygcatgcagtgctactttattgcttttamktatcwccaaactttgaatggcsggagccgttgggagagaagagacaagcagctcgcaattwmtwataymaagtgttktcagagcaggaaggtgattcggcaaacttccctctagtttggggcagtcacktatkthaagactkttaagcacaggaaaagcttctgaatcaaaggaactccacacctcccaacaaggcatgtgatsaatggycagagattcaagggagggaaagggcatccgacawtcttcattcttgtagaaacctgcatcaatagtcttcagcctattcaatcbtgmaatttcaaggwccttgagagaaggtagttgkccwagtgaaggaagcatactacagttgtcacaatcacttaa

SEQ ID NO: 632 - DNA, 401 bp, Artificial Sequence
  Consensus Reference Sequence
tgacaagttctccactgcactctctttcaaatcaagwytctccttgagttttaaatgagactcwagtgtgacaactatgtyytccaacttactaacratcttcctatcggraaagcgagraaamaagtttcttaccttcttttgggtggcagctttggtgaaaacatggtcgagtaartcatcggcytcatagacagcatctttgagatcatygagccagtstttgacattggtgtttgtgatctgtttcttctcrgcatcatcaagcacagctccaaccactctgakagtggwytccaacttttgaagcaacttcttgctaagyttctttccamggatcaagycaacaaactyaggtgaasccagcctgtcgaaaascacatcaagraaagcagagagaa

SEQ ID NO: 633 - DNA, 401 bp, Artificial Sequence
  Consensus Reference Sequence
  misc_feature 113: n = A,T,C or G
tgaacaaataaaaagagaaagaattgaacaaargrcacatgctaatkgatccctaagaacataatattaatgaattaaagwgttcaatatrtccttatytgtacataaaaaanaaaagaagtatgtagaaagaaaagtgtgtgattttttactaaataaaatcaataaataatagatactaatatagtaaagaatattgtaaagaagttktcataataataataataataataataataytcwagagggagtgattaaagtaattcctttgaaatggtgtcatcaaaattatcattcaatttaactatatttttatatgttgtatatctattataattatttgatgtatatttttatraaatttcttggtttctgaycatccttcatatcttatctataca

SEQ ID NO: 634 - DNA, 401 bp, Artificial Sequence
  Consensus Reference Sequence
aatataattagatataactctaataataaaaacttcattatttatttgttaaagtcttgaagatatttatcctcaaacttattttttctcctcaaaattatttttatcttttgtactaccaaacaaaactttacaagagtaatggcttagtagaattcaactaagtatcatctcttctcctaaatatttgttagagtcttcttaataaaataaatcttcttttaattttttaatcaatactctcaaaacaaagatgaaacacactttytaaaagtatthcattttatttattttatgaataaggagtattaaagtgtatttcactaaaaaaatcaaaaatawaatacattacattttttaataagatgaagtaaaagaagtgaaaaaatatatatatttaa

SEQ ID NO: 635 - DNA, 401 bp, Artificial Sequence
  Consensus Reference Sequence
agagcacaacgcgggaaggcattaactggttggtactgcgcatattcatccaccacgtggcaccatctgattggatgaccttgctactagtcabgggaagarcccgccttstggttaggtsttgaaggatgtttggcatagcatcattttcattgtccctaattcycaccaatctcacacccaaaagattttgtyactttataacaagggagctgttactaagmtttaataaaggaccaaaaagttttaatgataaactatacagtatttttaacaattttaatatactattattatatttttatttaatatttaaaaatatttctataatttaaacccwtgcattaagtataaagctagtaattttatattattattcactcatatatcatcattaatat

SEQ ID NO: 636 - DNA, 401 bp, Artificial Sequence
  Consensus Reference Sequence
atttttaagataattattrtagttattataaatsataaaataatattgaatgaagttttaaatttgatttacacttttattatatwacttattttttctatttatyaacaagacattacttttatagcaccatttgttgtcctatttcycactcccacatctaagttaactttgtttttttttccttgaatgttttgtcacattgtaacaagtggaattgttaagatttwaaaaaaagaaaattgtttgaatgaaattaaatttcaaacaattttaatattctaatattatattttttatttaayatttttaagttttaagttttcttagtatttaagaatatttattaacaagaccttttatggctatttttttattgaatgactatttttttttagtaa

SEQ ID NO: 637 - DNA, 401 bp, Artificial Sequence
  Consensus Reference Sequence
tttaatattctaatattatattttttatttaayatttttaagttttaagttttcttagtatttaagaatatttattaacaagaccttttatggctatttttttattgaatgactatttttttttagtaatgagaattttcatttcttttcactcactataatgataatgatgacgattgagttatgttcaagtgaagcgattgtatgcatgagtgcaaattaacttatttagttkaccagacttttcttataattcayaaaggttgttacagaaattcaatatatctaatttaagtatattaatgcattaaaatctatatatatatatatatatatatatatatatatatatatataagatatattctttaaattcttaatttaaattgtaagaaaggtga

SEQ ID NO: 638 - DNA, 401 bp, Artificial Sequence
  Consensus Reference Sequence
taattgayaatccaagaaatcaatgacatarccttctttctaaaacaattctctaaaattattaattatcatctaatcaactacyaacagtattagtgtgctttctgccatctgatgattgattgtttgattaaattttatttcttctgcataatgtgtggccatctytggtttygatttattcttgayttttkacaatcgtacatttctgtcatacttgtttagttcttcttggtcatgaattgtttatttttaagaactctaaaaacaactagagtacctgagagaaatgtaattgatgcgctaaatactttgtttttwaatccagtcctgtttaaatatgatcaaaaytcacctaatgccttrtggttttgggattgttaaaaaatgacatcagaaac

SEQ ID NO: 639 - DNA, 401 bp, Artificial Sequence
  Consensus Reference Sequence
ccatctgagctatccttgttcaaccttgatgacattggatgtttagtccactgtccatatctattttttgctcragcractgaggtgccaagaaatctcagccattgtgcaatatccaaacacaatgatygtgaagacggttgagctttgaattwcttgagtagcagtttcctgcttctggccgcgtgattgcctgtactcagtgctattgatattagcattggttttcaccasaaagtatttctagaaatggagcaaaaaggaggtgtgcytatgcaaygatatgaagtggggagattattaggccaaggaacctttgcgaaagtctaccatgctaggaacatcayaactggcatgagtttaagtttatatattaaagataaaataagaagaaaatwtaa

SEQ ID NO: 640 - DNA, 401 bp, Artificial Sequence
  Consensus Reference Sequence
gaagtggggagattattaggccaaggaacctttgcgaaagtctaccatgctaggaacatcayaactggcatgagtttaagtttatatattaaagataaaataagaagaaaatwtaaaatgttagaagcwggcatttttwaaaatattaatttaagtaatattttaaaaaatgttaaaaactactaaaaaaacttgtttatcaaatagtcaaacaagttttttaactagtaaagaaagttagaagtcatttgaaatgtgttcacaaacatatctttaaacaagattgaaaaaaaaactaggcaatatccttaagcaaccattaarytaggactaagaaactaaaaattaatttttttttattaaaaaatacaacagaacatttctttacaaatctaactaaa

SEQ ID NO: 641 - DNA, 401 bp, Artificial Sequence
  Consensus Reference Sequence
  misc_feature 317, 320, 321: n = A,T,C or G
tttactaaataaaaccaataarataaataaataatagataytaatatactatattaagttttgacatgcagatatccccatgatwttatatttatattaaaaaaataggcttccadgtatsaaaaatagractcasagagaakgggagtggcggatacaagccagatcttgcataatggtaattaggaaaaacaaacccaaaccccctccytttcctaaggcattacttaktctcagcctctacactctccttacaagctatccattccattatgycaacctatgttccttttccacttcagctagtgcaacttgtncgnntgattcyttctgctgtcatacacaagcaggtcttgttwctgaggcccatttgtcctttctttttctattcccccacyccc

SEQ ID NO: 642 - DNA, 401 bp, Artificial Sequence
  Consensus Reference Sequence
  misc_feature 120, 123, 124: n = A,T,C or G
ccaraccccctccytttcctaaggcattacttaktctcagcctctacactctccttacaagctatccattccattatgycaacctatgttccttttccacttcagctagtgcaacttgtncgnntgattcyttctgctgtcatacacaagcaggtcttgttwctgaggcccatttgtcctttctttttctattcccccaccccctcttttccctatccttttatataccttcattatggacctatcaagttctaaccagraaaattycaaaaayatttctaacccaaatctcsaaattcacatgatgtcaaatcagaaaaamaaactaaataaataagaaaatgtsattaaaaataatatataacactacagagaaaaaaatcaraaaattawttttccat

SEQ ID NO: 643 - DNA, 401 bp, Artificial Sequence
  Consensus Reference Sequence
tgaatccactkattttatttgttataatttrcacccactgacttagggtcttggatccgccactgtctggaagaatgatgcttgtcgtgtaggrgtaracaaacttaaccatttcctgatattytgtagcacaaaaagayaarttygattattragaaatyartataaataatacwatgtaataayagcatcaatcaatgaaatatacaaytgttccttcccttattcttttctctatggagrccctggtcctyraaaaccagcttctatcttcttycctatcaacaagaatatagcatatataattatgtatgataattttaagaaaataaacaacactaatagaatggtaaaatasaaaaaaaaaatcatagctgcayttccagaagcatcttatggaa

SEQ ID NO: 644 - DNA, 401 bp, Artificial Sequence
  Consensus Reference Sequence
tacagtggactgyagcaacaattttctcrctagcaaaagtaagggattaatgaattgtttatggtatgacagttagtcatcatgaagggactactaacataaacttaattgcacgacmatatttacgggatatgattgaacattttgatacaacataaagaccttgacttgtaaaaattgaaggbgcgtgcttcaagcacaaataaaaagctctcattcwgacctaaggagacatgttatacaatacacttcacgtgagtgytctagattgaagtagcctccattttgaggaagcttttttcygraacwtgtttgttgtctttgtattgttctttagaattaaagtctattatgccagtagtgcatatagtttrtctcaagtaaatcactaawgattraay

SEQ ID NO: 645 - DNA, 401 bp, Artificial Sequence
  Consensus Reference Sequence
tcgccttgkrtttctgtatggtgccatcarggttgagctttgtcttatrgacccacttaaccccaatgatatcttttccatggggacratttrctaactcccatgtgttrtttttctcgatcatytgtatctcttcttccattgccttsacccatacttcctgctttgacgmttcttcaaagcttccaggttcaagtatgaccaagttacaggtttcatatatgtccaccaaagatcttactcgtyttggagtagactctggcgatgatagttcttgatcttgttgttgtggtggaggtgaaggtggttcacytgggtyttcatcctcagcttcttcttgaggtagttgarcgggtataagaacattcttctccactttttcttcatctcaattccaagaa

SEQ ID NO: 646 - DNA, 401 bp, Artificial Sequence
  Consensus Reference Sequence
  misc_feature 175: n = A,T,C or G
cgacacctcgcgcttaacgtgttcagatcgtgygcttagygsgtgctgcaggcttagygtgtgattctattggattgcgcgcttagcgtgtgcctcgcgcttagtgcacgtaacraatcctgcatcttcgtacttaacgcctcgcttagcgcctgtgcttgcttgcatgcttagngcgcyaagcgcgcgtgttgagcggaccctsctttagattttcttctttttcttcaatttttgttgccttttkgcttgttgtaccttcarttttgatatccgtggctagaaattcaaacttaatwagttttctaacatttaatcacaaataactrctaaataattaattttaagccaaaatttgactgattccctactattaattcamwattatttagcaattatca

SEQ ID NO: 647 - DNA, 401 bp, Artificial Sequence
  Consensus Reference Sequence
  misc_feature 47: n = A,T,C or G
cgtacttaacgcctcgcttagcgcctgtgcttgcttgcatgcttagngcgcyaagcgcgcgtgttgagcggascctsctttagattttcttctttttcttcaatttttgttgccttttkgcttgttgtaccttcarttttgatatccgtggctagaaattcaaacttaatwagttttctaacatttaatcacaaataactactaaataattaattttaagccaaaatttgactgattccctactattaattcamwattatttagcaattatcaacaagtagtaatgacttgtatttcttaaccaaatggtctagagtttgaattttggttaacccttatgcatagaatwaaagaaagaamacatgctaattgatctctaagaacataatattaatgaatta

SEQ ID NO: 648 - DNA, 401 bp, Artificial Sequence
  Consensus Reference Sequence
gcgcgcgtgttgagcggascctsctttagattttcttctttttcttcaatttttgttgccttttkgcttgttgtaccttcarttttgatatccgtggctagaaattcaaacttaatwagttttctaacatttaatcacaaataactrctaaataattaattttaagccaaaatttgactgattccctactattaattcamaattatttagcaattatcaacaagtagtaatgacttgtatttcttaaccaaatggtctagagtttgaattttggttaacccttatgcatagaatwaaagaaagaamacatgctaattgatctctaagaacataatattaatgaattaaagatttcaatgtccttacatatatgtcaaagatgtatgcagaaagaaaagtgr

SEQ ID NO: 649 - DNA, 401 bp, Artificial Sequence
  Consensus Reference Sequence
  misc_feature 392: n = A,T,C or G
caattagaaaacaagaccaagagagcaatwacaaggcccacttacctcaaggattaggtgtgaarcaakcaggtgcaccatatctggaagaatgatgctggtcrtgtaggggtagacaaacttaaycatttcctgatattytgtagcacaaaaagacaaattcgattattgagaaatcagtataaataatactatgtaataacagcatcaatcaatggaatatacaactgttccttcccttattcttttctatgtggaggccctggtcctcvaaaaccagcttctatcttcttccctatcaacaagtatatagcatatataattatgtatgataattttaagaaaataaacarcactaatataaaatatatagaatggtaaaatacaaaaanaaaaaacaa

SEQ ID NO: 650 - DNA, 401 bp, Artificial Sequence
  Consensus Reference Sequence
ggtcatatgatgctatatagaatgcaacaacttctatcattttttgctctagtggtaaaattyaatttgaattcttagattttatttgcacagaaaaaaaaagaggagtttttaggagttcttctcctaaaattcaaccttcatcaygaaatwctcttgaataagaataatggtarttagtggcggacctgcatatatataagagtgtgcaggtgcaccccctgacttggtaaaattattattaagtattttaaattttttttattttgctccctctaatcctatatatttgaacccamkgtcctatatattttaaaattgtctcaattaactcagggtcttagatccgccactaatgatagttttagtgcacmggggttcttgagctcaatcaagaatcc

SEQ ID NO: 651 - DNA, 401 bp, Artificial Sequence
  Consensus Reference Sequence
ggtttttcgabgagctygagaaactatttgccatcgacatgcaagctcagatggcaagagatcakaggakacattgcttaaggttaggagaatacttagggttgttgagaaaaygtgcttcgaccctggggaggcaattgaaaacacgytgttaatgtttttgacgtgkatttctgtctttgytrtgaagctaataagggcagcttttacgttttcttccactaaacaggagcagwtttcacttgataaacaattgaagaggaaaaaasrctacttgctctctgccaggagtctcacagttttwtggggagagggagacactcctaggtattgggggtgggctggggtcaggtaattatttcttgttttctrattaattagttaattgtgccaatattttt

SEQ ID NO: 652 - DNA, 401 bp, Artificial Sequence
  Consensus Reference Sequence
gacatgcaagctcagatggcaagagatcakaggakacattgcttaaggttaggagaatacttagggttgttgagaaaaygtgcttcgaccctggggaggcaattgaaaacacgytgttaatgtttttgacgtgkatttctgtctttgytrtgaagctaataagggyagcttttacgttttcttccactaaacaggagcagatttcacttgataaacaattgaagaggaaaaaasrctacttgctctctgccaggagtctcacagttttwtggggagagggagacactcctaggtattgggggtgggctggggtcaggtaattatttcttgttttctrattaattagttaattgtgccaatatttttatttggtttaattactccgttacttgaattcgtat

SEQ ID NO: 653 - DNA, 401 bp, Artificial Sequence
  Consensus Reference Sequence
aattgttgtaattgaaaagtagtttgataggtagaaggaggcacaggggtaacaaacacacgggttccatgctcaactarcagaaaatgtrgtgcaaacmrcaagcctgcttcaaggacttgcgtggtgcacgtatgaagaatagtggcgtgaatggragctaacctggattgtgaaaatggaatacaaattgcaaaathatcaatgatttytagaatatttcctttatacaaaatgacaaattctattattagggaagtggtataaataaaagcatttgtaaaccattgagggatatgaatgaacaaaatacaagcttcctttccttcrgtgcctttttctctcttcttcttccttgcattctggaggtgctagtcccgaatccagcaatttccctgygt

SEQ ID NO: 654 - DNA, 401 bp, Artificial Sequence
  Consensus Reference Sequence
ttgaaaagtagtttgataggtagaaggaggcacaggggtaacaaacacacgggttccatgctcaactarcagaaaatgtrgtgcaaacmrcaagcctgcttcaaggacttgcgtggtgcacgtatgaagaatagtggcgtgaatggragctaacctggattgtgaaaatggaatacaaattgcaaaathrtcaatgatttctagaatatttcctttatacaaaatgacaaattctattattagggaagtggtataaataaaagcatttgtaaaccattgagggatatgaatgaacaaaatacaagcttcctttccttcrgtgcctttttctctcttcttcttccttgcattctggaggtgctagtcccgaatccagcaatttccctgygtttgcacrtaac

SEQ ID NO: 655 - DNA, 401 bp, Artificial Sequence
  Consensus Reference Sequence
  misc_feature 239, 240: n = A,T,C or G
caacayggcataattaaaagttagyagacstctgyaattttctaaatcgtagtcattgactcagatttacactaagagtgyrtttggatagataagtttaactrataaaagtaatttatcagakaatttgaatttctgtaatygaaaattcattstttagatattttttgtgaaaaatttaaatttttggaattttaaaacagaattttaaataactaaaaatgtgaaatttmaatttnntcctaaaakgtgagaaattgaaattmtctttttataaaagaattttctaaaacgttcrcktatttacttactaacctttatcattttttctacgtgaaaawtttcaaagttctgttctcgaactagagactctaccctcacaccgataattcttttcttca

SEQ ID NO: 656 - DNA, 401 bp, Artificial Sequence
  Consensus Reference Sequence
  misc_feature 329: n = A,T,C or G
ttwctaaatataatataatatayttaatcattttaagatcattagaaactcytaatrtaaaactaattcaaatatttcataaaaattattattcttcaaagtatttatcatcaccagtattctttcatatgataagttatcgcccgattatgcaattaaaggactaaaaatatacataaattagataatttagtagtwagaatgtttttgtcttacaagcaaaatataatattaaacatctataacaattcatcttacaaragtgttacttttcttttggctaaaaataattatcgtcatacrttattttatataaataaaaaaataanttttttttataaaaktaactttatattatcattaatttatttttaaattttatagttcatmattcatatata

SEQ ID NO: 657 - DNA, 401 bp, Artificial Sequence
  Consensus Reference Sequence
  misc_feature 227: n = A,T,C or G
atttatcatcaccagtattctttcatatgataagttatcgcccgattatgcaattaaaggactaaaaatatacataaattagataatttagtagtwagwatgtttttgtcttacaagcaaaatataatattaaacatctataacaattcatcttacaaragtgttacttttcttttggctaaaaataattatcgtcatacattattttatataaataaaaaaataanttttttttataaaaktaactttatattatcattaatttatttttaaattttatagttcatmattcatatataagaaatataartaaaaaaattaattttatattaaaaagtcaaaataacaattattttaraattattattktttacacgacaattataatggagcagatgaca

SEQ ID NO: 658 - DNA, 401 bp, Artificial Sequence
  Consensus Reference Sequence
  misc_feature 118: n = A,T,C or G
cttacaagcaaaatataatattaaacatctataacaattcatcttacaaragtgttacttttcttttggctaaaaataattatcgtcatacrttattttatataaataaaaaaataanttttttttataaaaktaactttatattatcattaatttatttttaaattttatagttcatmattcatatataagaaatataaataaaaaaattaattttatattaaaaagtcaaaataacaattattttaraattattattktttacacgacaattataatggagcagatgacataataataattaatwtaagtgatattagagattcatataataattaattagttttaagaaatatttaatttcatttttttcatttaatttaattaatttatatttaaaa

SEQ ID NO: 659 - DNA, 401 bp, Artificial Sequence
  Consensus Reference Sequence
attctcatataattttataaatacrcgcccgaatttttttatyaaatatatgtttcgtgcataayaagagagttgaataagtattgagtgtcattgttattctttcaaaaattagaattcaactaccatcttgacatcttaaagccacctcacttagtcgtagmacctggcataatatttaatttataagtaatgttttcgrtcagtattctaattaataagaattctagcttataaaaatattggatttaataaataacatayaaatttaaatattttaacycaataatttaattgaaatcgtatacaaatgactcaaatcaactcattcaattataattgaattaagtcattataatwgaattaagtcataggtatgatgaaactcaatccaaacttac

SEQ ID NO: 660 - DNA, 401 bp, Artificial Sequence
  Consensus Reference Sequence
taatttaattgaaatcgtatacaaatgactcaaatcaactcattcaattataattgaattaagtcattataatwgaattaagtcataggtatgatgaaactcaatccaaacttacctgcatacacctctatgttggctggctgaatttttaaaacaaaattktcttgtattttaaaagtggatttgtgcaattcgtgcaaggaagkttttgtgttaaataattgatgaaaaagaattcgtggcgaattatcttttgtcaaatmtgcccaaggtgtgatcgattttgtcaaaacccattttatatttgtaattaatattttattttaaaatttattgttacagttcgtacgtatacagkttagtgatatagtttacagttcgtgtgtttcatrccaatatat

SEQ ID NO: 661 - DNA, 401 bp, Artificial Sequence
  Consensus Reference Sequence
taattgaaatcgtatacaaatgactcaaatcaactcattcaattataattgaattaagtcattataatwgaattaagtcataggtatgatgaaactcaatccaaacttacctgcatacacctctatgttggctggctgaatttttaaaacaaaattktcttgtattttaaaagtggatttgtgcaattcgtgcaakgaaggttttgtgttaaataattgatgaaaaagaattcgtggcgaattatcttttgtcaaatmtgcccaaggtgtgatcgattttgtcaaaacccattttatatttgtaattaatattttattttaaaatttattgttacagttcgtacgtatacagkttagtgatatagtttacagttcgtgtgtttcatrccaatatatmattt

SEQ ID NO: 662 - DNA, 401 bp, Artificial Sequence
  Consensus Reference Sequence
gtcattataatwgaattaagtcataggtatgatgaaactcaatccaaacttacctgcatacacctctatgttggctggctgaatttttaaaacaaaattktcttgtattttaaaagtggatttgtgcaattcgtgcaakgaagkttttgtgttaaataattgatgaaaaagaattcgtggcgaattatcttttgtcaaatatgcccaaggtgtgatcgattttgtcaaaacccattttatatttgtaattaatattttattttaaaatttattgttacagttcgtacgtatacagkttagtgatatagtttacagttcgtgtgtttcatrccaatatatmattttcktaaataaattgcacgaatcctttgcatcactcatatatacaagtgctgcaactt

SEQ ID NO: 663 - DNA, 401 bp, Artificial Sequence
  Consensus Reference Sequence
catatatgctttttacattttttttaatcgatattcattttataaaatcataaccgtccattctatgtttygtgtaattcrtgtggatttacytttcataacagatwgcatcattctgtttgtattttgtgcaaataattttcgtactaagtagcaacrttgataaataaaacsaaaaagagattatgatgatgatgattggtacaaattgtattgcatgaattacaaattaattccgtcactaaactgcatatttgcgccargtatgattttgtcaaaaccyatttaatatttgtaattaatattattattattattattaacgaaaaacatgtgttgtcacrctttatgtttatatytctattttgctaacmcatttttattatattaaatttaaaatt

SEQ ID NO: 664 - DNA, 401 bp, Artificial Sequence
  Consensus Reference Sequence
actacccacwaagaaattagagaatttgttcctttcaagtgcttgcytcgtgtttttatgagacaattcatcatcataatataatctcaaaataatatctattccttatcagaaaaggataytaccaagatacttacaaaattaacatttaaatgttsaaaattrtctcatataagataatatatattaataatgattgccarcaaataartagcatgaagtacrttaagaagaaaaaaaaaatcccttctttttattcaatttttttttctctcgttctagcgactaaatattttatatcgaaccatcttgaattagacaacattgttttcaaagaaaatgaagtatgggagaatatgttgagtttaattartggaggtamttyacaaawwttttagaag

SEQ ID NO: 665 - DNA, 401 bp, Artificial Sequence
  Consensus Reference Sequence
cttatcagaaaaggataytaccaagatacttacaaaattaacatttaaatgttsaaaattrtctcatataagataatatatattaataatgattgcyarcaaataartagcatgaagtacrttaagaagaaaaaaaaaatcccttctttttattcaatttttttttctctcgttctagcgactaaatattttatatcgaaccatcttgaattagacaacattgttttcaaagaaaatgaagtatgggagaatatgttgagtttaattartggaggtamttyacaaawwttttagaaggaaggtaattgtttagacatttttgttaatgggagcgaggaaatctttggaggtgatgatcccctctcaatttcsgaataaataaccgaagaayaattaaaact

SEQ ID NO: 666 - DNA, 401 bp, Artificial Sequence
  Consensus Reference Sequence
  misc_feature 365: n = A,T,C or G
attggttttgtttcgataagcaaaacaatatagcttttaaatagggttttctaactaaacctaagtaaaaatttcactgaaaaattcaaacttgcttcttatgatwtttaatgaaattcaaataacattctagaaaatatgtagcggtaaacatggcaggagataggtaagtacaggaatatgttgggycgttcacagcacgaacttgagccactgatacaactattgaggaagagcaaagaggttgtttacaagtgttcaaaaatagggaaatacaattttgtggctaagaaattcttaccgwggaaaactaaaattaaagatcttgcagactcaattgagaggtttttcaatattgaaatgcnagctcttattgcacgcgatcaacttgagatcttgct

SEQ ID NO: 667 - DNA, 401 bp, Artificial Sequence
  Consensus Reference Sequence
attaagtaattaaccaacaagtttcatcctcacgtatgctascctcatcaacttaatcagctcactgctgkagcaagattggaggatccagcttcagcatactcttcatgaagacacgtatgtgcaggttggcttscwaagttaatttggagcgtgataattcatttctggtttggcaacatttcccacctcaactatctatgtctcttttagtaaatkcagtagggattstaagattatgtgctyagtttrctttgtttttttagttttatgatgtawaaaaaawtatagatcagttagtwgtttggttttaggtwttgttctggtctagatcggatcatgttcygatcttctacatctttagcttttacgcactstgtgcttgaagctaaggggttatc

SEQ ID NO: 668 - DNA, 401 bp, Artificial Sequence
  Consensus Reference Sequence
aggtygattcactttcaaagttgggccytgycaggygggatcaaacgaycaccttaagggggattgacgataatccgactatttcsgcaraataagggattaactgattgtttatgatatgctggttagtsatgcatcatgaagggacaactaacataaacttawtagcacgaaacatttgcgggatatgatggaatattatgatgcagcataaagaccycgacytgyaaaaattgcggggggaccgaatgtgcttcattttgaggaggctttttccggaacaggtttgttatattttattgyatgttatttagaccggaacaggtttrttatatttttattgcatgttatttagaattaaagtctattatatcacttgtgcatatagcttgcgtcaagtg

SEQ ID NO: 669 - DNA, 401 bp, Artificial Sequence
  Consensus Reference Sequence
  misc_feature 63: n = A,T,C or G
ttgagattcttagaacatttttggtcaaakaatycattttagkttcttgrattattttttgtnagtcccatgatgttatatagratgcamgaacttytatcattttttattctartastagaatccaattyggattattagattttactagcacaagaaaaaataatatttttgaaaaaataggarttcttttcctagaaccyaatctccatcttaaaaaactcttaataagaataatagtaratctagtggatagrgttcttgagttcaagaatcccattaaagatgytmttgggcctttracaaaytgtccatgttgtgctactcattaacaaaccygtgcttayatttcataggctcyvgtgaaataatagataaaagttatttatatacaaatattt

SEQ ID NO: 670 - DNA, 401 bp, Artificial Sequence
  Consensus Reference Sequence
attaaagatgytmttgggcctttracaaaytgtccatgttgtgctactcattaacaaaccygtgcttayatttcataggctcyvgtgaaataatagataaaagttatttatatacaaatatttctaaacattattaaatgtattacataaaaactatagrccaataatatcattaaaaatgacgcattttaatatgttaaacaaataagataatttcaaycartctcgaacagaaaatatatakagagagagatatcgagtttaatamttatgtattgatgatgtaaaatgattttacactattataaattattgtttgaattactttaaaataattattttaaaagtcaacaaacttatcacatagtgagttryaattaggtaawggtttaaatatattt

SEQ ID NO: 671 - DNA, 401 bp, Artificial Sequence
  Consensus Reference Sequence
ctactcattaacaaaccygtgcttayatttcataggctcyvgtgaaataatagataaaagttatttatatacaaatatttctaaacattattaaatgtattacataaaaactatagrccaataatatcattaaaaatgacgcattttaatatgttaarcaaataagataatttcaaycartctcgaacagaaaatatatagagagagagatatcgagtttaatamttatgtattgatgatgtaaaatgattttacactattataaattattgtttgaattactttaaaataattattttaaaagtcaacaaacttatcacatagtgagttryaattaggtaawggtttaaatatatttttggtctctgataaatactcattttttrcatttgktccctaat

SEQ ID NO: 672 - DNA, 401 bp, Artificial Sequence
  Consensus Reference Sequence
ayatttcataggctcyvgtgaaataatagataaaagttatttatatacaaatatttctaaacattattaaatgtattacataaaaactatagrccaataatatcattaaaaatgacgcattttaatatgttaarcaaataagataatttcaaycartctcgaacagaaaatatatakagagagagatatcgagtttaataattatgtattgatgatgtaaaatgattttacactattataaattattgtttgaattactttaaaataattattttaaaagtcaacaaacttatcacatagtgagttryaattaggtaawggtttaaatatatttttggtctctgataaatactcattttttrcatttgktccctaataaatttttgctttrtgatgggtcc

SEQ ID NO: 673 - DNA, 401 bp, Artificial Sequence
  Consensus Reference Sequence
tattttaaaagtcaacaaacttatcacatagtgagttryaattaggtaawggtttaaatatatttttggtctctgataaatactcattttttrcatttgktccctaataaatttttgctttrtgatgggtcccwaatatttaaaaagctttgtccraagttcctrccrttagtcgaaatccattatcttcatatgtgatcattaaccgattgtcgcaacctacccttcggcgggagggcgacgcgtgactcgcgggatgcgtgttccacgaaaggaatacccgcggagttgccaccaacgtttatttgaggaaaatgtcggaaaaaccggaaaagacgcgatctacgaacttttaagtgaaaggctcgggagttgtattcacgcacggggaaggtattagc

SEQ ID NO: 674 - DNA, 401 bp, Artificial Sequence
  Consensus Reference Sequence
ttccttctcttcacctacgacacacaagtggrttkgagggccaagtgtgagagagagactgrgagagaagtgaggtttgwgagttgaaggaagttaytggtggtagctggcgctggcacgagcagtggcacgaytggcarcaccagtggtggcygatggctgggttggtggtgacctttaagaagggagaacaagaagagacaaccatgaaagcaagggtttgcaaaaagagctcgcaactatgaawggtcgaygacaagttcagacatcrctatcccactcattttttcgtgctctatkcaatggaccgagckgaatcgcattttagggtaatttgttgaccttcttctacccatgaaactattttgatgtgttctcttagaaaccttatccatgtgaat

SEQ ID NO: 675 - DNA, 401 bp, Artificial Sequence
  Consensus Reference Sequence
aatggaccgagckgaatcgcattttagggtaatttgttgaccttcttctacccatgaaactattttgatgtgttctcttagaaaccttatccatgtgaatttcttgagttggkarttggcttggtttgatttgaaaatgyaaaattgattgcaaggtcctaaaaatcrttggtgaggaccwcttcaccttggatcttyacaagtgacgaagtcatagtgayaaatccataagraaggtatagaagaaactatartgggttgtgtgaaaacgtagaggaatgctgaagartgattytttgatgcccaagggattttgactatagtttcttatcattagtcaaaatccgttatttgytgaagaatgattctttkatgyccaargrattttgactatagtttct

SEQ ID NO: 676 - DNA, 401 bp, Artificial Sequence
  Consensus Reference Sequence
gcaaaaatttattaaagatcaaatgcwatycattccattatgccaacctatgttccttttccacttcagyyagtgcaacttgtackgctgattctttcwgctgtcatacacaagcakgtcttgtttytgaggcccatttgtcctttmtttttctattccycaccccctcttttccctatccttttatataccttyattataracctatcaagttctaaccaggaaaattccaaaaacatttytaacccaaatctccaaatttacatgatgtsaaatcagaaayaaactaataaataagaaaatgtgattaaaaataatatataacactacagagaaaaaaatcagaaaattmwttttccatgcatactatamagagattacaaagtmwraaaatatatatt

SEQ ID NO: 677 - DNA, 401 bp, Artificial Sequence
  Consensus Reference Sequence
agtgcaacttgtackgctgattctttcwgctgtcatacacaagcakgtcttgtttytgaggcccatttgtcctttmtttttctattccycaccccctcttttccctatccttttatataccttyattatrracctatcaagttctaaccaggaaaattccaaaaacatttytaacccaaatctccaaatttacatgatgtcaaatcagaaayaaactaataaataagaaaatgtgattaaaaataatatataacactacagagaaaaaaatcagaaaattmwttttccatgcatactatamagagattacaaagtmwraaaatatatattttcatgggaraaatgttcatgtgaacacaataattaccttgactyyrtatagtgatattttgttgcatatc

SEQ ID NO: 678 - DNA, 401 bp, Artificial Sequence
  Consensus Reference Sequence
attaaaaataatatataacactacagagaaaaaaatcagaaaattmwttttccatgcatactatamagagattacaaagtmwraaaatatatattttcatgggaraaatgttcatgtgaacacaataattaccttgactyyrtatagtgatattttgttgcatatcattgcagcaactttktcaagagaatgacttgagtgtttcccacctctagcttcttcttcaattttatttgcagaactgttgraatttgaatcagtgggaacttgcagcaagcaagcaacaraagcaagggggtgyaattaraaaayaagaccaagagagcaattacaagacccacttacytcaaggattaggtgtgaaacaagcaggtgcatcatatctggaagaatgatgctgg

SEQ ID NO: 679 - DNA, 401 bp, Artificial Sequence
  Consensus Reference Sequence
ggggtgyaattaraaaayaagaccaagagagcaattacaagacccacttacytcaaggattaggtgtgaaacaagcaggtgcatcatatctggaagaatgatgctggtcggrtaggaatagacaaacttaacmatttyctgatattytgtagcacaaaaagayaaattsgattaktragaaatcagtataaataatactacgtaataacaacatyaatcaatggaatatacaattrttccttcccttattcttctcattcttctctccrtggaggccctggtccttgaaaamcagcttctatcttcttccctatcaacaagtatatarcatatataattatgtatgataattttaagaaaawaaacaacactaatataaaatatatagaatagtaaaatac

SEQ ID NO: 680 - DNA, 401 bp, Artificial Sequence
  Consensus Reference Sequence
ttatgtatgataattttaagaaaawaaacaacactaatataaaatatatagaatagtaaaatacaaaaaaaaaacaagatcatatctgcatttccagaagtatcttatggaatctagattacccaggaagwkaaattaaaaacttgaaaraagaaacagagaaaaaagaaaatattttaagataagttgtaacccggaatcaaaataaaagtttataaatarttcaagcacatatatatattttggtgtcttgatcttattgatgtattttgcagacattgatatacttttattaccctatagagctrgarcaagatcaactaattgaaggtttagtgacattgtcacaaagcaaagaaaatgcctgatttatgaatattcacyttgaatctacgtgagtc

SEQ ID NO: 681 - DNA, 401 bp, Artificial Sequence
  Consensus Reference Sequence
attaagaaaacyaaaaattgtatcagatgatatttctctttttcaaaacyaatctaatctactccataaactccttttaatcbgasaactattaggaaagtgaaaaggaaaatataaaaaattaaaaaagtaaataattkgactttgtaraagtcataaccacattctttatcatycttctcttctyygtyccctcattgatgcacykgacacatttctttaacacgttgtcctattgtctgatcaataggaacatgatatatcgcctcgttatttwcwratcatgcaattgcattgatttattttctgttcttatcatgattggttccacattattattatgtcwtgcacttcatcatggtgcgttgcactaatattaatgatcgytctacaaatctttg

SEQ ID NO: 682 - DNA, 401 bp, Artificial Sequence
  Consensus Reference Sequence
  misc_feature 223, 225: n = A,T,C or G
tttaacacgttgtcctattgtctgatcaataggaacatgatatatcgcctcgttatttwcwratcatgcaattgcattgatttattttctgttcttatcatgattggttccacattattattatgtcwtgcacttcatcatggtgcgttgcactaatattaatgatcgytctacaaatctttgttgtaccccttaaatttcattggcttytgccttttttttntnatgraaattaattaattaacattkgtttttkaagtgcttgttaattacaggcaccatkgaggaaagagtgrgacttttgtttytgattttgtcatgcaagagaggtaacaattgttagattggcctttttcttatctttttgcttttaaatttaattatcrtgctaagtgagatgg

SEQ ID NO: 683 - DNA, 401 bp, Artificial Sequence
  Consensus Reference Sequence
  misc_feature 195, 197: n = A,T,C or G
ataggaacatgatatatcgcctcgttatttwcwratcatgcaattgcattgatttattttctgttcttatcatgattggttccacattattattatgtcwtgcacttcatcatggtgcgttgcactaatattaatgatcgytctacaaatctttgttgtaccccttaaatttyattggcttytgccttttttttntnatgaaaattaattaattaacattkgtttttkaagtgcttgttaattacaggcaccatkgaggaaagagtgrgacttttgtttytgattttgtcatgcaagagaggtaacaattgttagattggcctttttcttatctttttgcttttaaatttaattatcrtgctaagtgagatggatayaamrtagttacaactcacaccaaa

SEQ ID NO: 684 - DNA, 401 bp, Artificial Sequence
  Consensus Reference Sequence
tkaagtgcttgttaattacaggcaccatkgaggaaagagtgrgacttttgtttytgattttgtcatgcaagagaggtaacaattgttagattggcctttttcttatctttttgcttttaaatttaattatcrtgctaagtgagatggatayaamrtagttacaactcacaccaaayttactgtaccataataaagtttacctgrttcttgtagtaataatataaatagtgaygaaccacataccttctaaaaccaaatacycatacctgtttmatatacctartaacttagagatagaatgcaagacttgwattattcactctcctatatatttatttamcaaaytttggtggaaattttaaggagtgacaggttcatawtagcttttaaccatcaatgga

SEQ ID NO: 685 - DNA, 401 bp, Artificial Sequence
  Consensus Reference Sequence
agtgcttgttaattacaggcaccatkgaggaaagagtgrgacttttgtttytgattttgtcatgcaagagaggtaacaattgttagattggcctttttcttatctttttgcttttaaatttaattatcrtgctaagtgagatggatayaamrtagttacaactcacaccaaayttactgtaccataataaagtttacytgattcttgtagtaataatataaatagtgaygaaccacataccttctaaaaccaaatacycatacctgtttmatatacctartaacttagagatagaatgcaagacttgwattattcactctcctatatatttatttamcaaaytttggtggaaattttaaggagtgacaggttcatawtagcttttaaccatcaatggaaaa

SEQ ID NO: 686 - DNA, 401 bp, Artificial Sequence
  Consensus Reference Sequence
gaggtaacaattgttagattggcctttttcttatctttttgcttttaaatttaattatcrtgctaagtgagatggatayaamrtagttacaactcacaccaaayttactgtaccataataaagtttacytgrttcttgtagtaataatataaatagtgaygaaccacataccttctaaaaccaaatacycatacctgtttaatatacctartaacttagagatagaatgcaagacttgwattattcactctcctatatatttatttamcaaaytttggtggaaattttaaggagtgacaggttcatawtagcttttaaccatcaatggaaaactggtaaaaagaaaaggctggcactaacaaccagttatttgtchataggaaaggaagcttgggcccaat

SEQ ID NO: 687 - DNA, 401 bp, Artificial Sequence
  Consensus Reference Sequence
aaaattagtgtstctttgatttcagaagctttacttytttttttccaatacttacaaaaatatcatcttatttttttttacctcatgtcatgrtttgaagaatgtgttttgctacaaagtactgatactttaatttgcttcwtgcatytatatctgataccaatatatctgatacatatatgtgaagtgaccaattctttaaaaaaaattatgataatcaaatatagtgacatrtaacatagawgtaagtataatataraaatataaaaagtattgtttcttgatgaaccaatatgaaaattgttttgtttatagataatttcmagaaagaaatgagattgatcattgatagtaccattcttatttgtgawcaataggaaaaaatgatstacaattttttk

SEQ ID NO: 688 - DNA, 401 bp, Artificial Sequence
  Consensus Reference Sequence
aakraattggatttagtaaaacgtaaaagkagaaagacatgaaatgaaacatatccttgacagaaatagttttstagttggttagacttagaagatacctgttggtcmtccttggtggctaaatccatctawsrtcaacctsaatgccagggatgtgggaaattttaggccaaatttgagggtgcttcatgcggyatcgtatttccagcaaaggacaahtcaytatggttaattttattagagagacaggaascctttctcccaccatattttccagcaaaggacatcyymwtatggttaattbttgcagggatgtgagatggagaagccccgtgcagtccaacatctccagatttgacawgtbawmtakakacagakacgtaagggwgggaggcagcaaa

SEQ ID NO: 689 - DNA, 401 bp, Artificial Sequence
  Consensus Reference Sequence
agaagatacctgttggtcmtccttggtggctaaatccatctawsrtcaacctsaatgccagggatgtgggaaattttaggccaaatttgagggtgcttcatgcggyatcgtwtttccagcaaaggacaahtcaytatggttaattttattagagagacaggaascctttctcccaccatattttccagcaaaggacatcycmwtatggttaattbttgcagggatgtgagatggagaagccccgtgcagtccaacatctccagatttgacawgtbawmtakakacagakacgtaagggwgggaggcagcaaaccctcyttagggaaggacttgatgccatcacatsgaccatmaacactgagatgagtaagcatgcccatggatggccatgctaggccgct

SEQ ID NO: 690 - DNA, 401 bp, Artificial Sequence
  Consensus Reference Sequence
agagacaggaascctttctcccaccatattttccagcaaaggacatcyymwtatggttaattbttgcagggatgtgagatggagaagccccgtgcagtccaacatctccagatttgacawgtbawmtakakacagakacgtaagggwgggaggcagcaaaccctcyttagggaaggacttgatgccatcacatsgaccataaacactgagatgagtaagcatgcccatggatggccatgctaggccgctcagtagtttctcacaattgtaaatcgatactgttctcaggtcaggtggcataccccgttttggaaaggactcaatttctgggcagttgaatatttygagacattctaactttgggagaagactactcatctcttcakgcaacgacttcaact

SEQ ID NO: 691 - DNA, 401 bp, Artificial Sequence
  Consensus Reference Sequence
gyctwytatatvcaacgattcaatgttaaagtgaggctgtarcttgcaaagcacatctatttcaagttggaagttgktactgttgttgttacatcyagaccathccaactgtaaactattaatgtgttttttatccatcatccttgcctccaamgcttcatcactttgggaaacattctccawgttcctaakttcaagwtcaccaygaagatttgaaagtcctcccaattctttgatyccattctcttcgtgcttgcccacaacaaagaaatccagacgttgtaaatgatttaatttactcattcctctcggcatctcttttataggagtwwaagaaataycaagatgacgcaagttaacaagattscrcatgtcaytaggcaacttggtcagttttctgc

SEQ ID NO: 692 - DNA, 401 bp, Artificial Sequence
  Consensus Reference Sequence
ttygacaywatgatacattgtgcctcctcrttgttgaatggagcagcttcaaaattkataatggacaagaaagttctcagaaattttgctctaccaayaacatcaragttgtccaagactgaagaattgaatttggyaaatgacaaatgacgagtyttagtattgatctttgtttctttcccaagttcttctgatctaaaataaaaatctccaccgastgatktggctagatcatgcatgaggtcatgcatcacaaaacattcgccataaggcctactacttctatytgtacttgaacgttggaaaaayratctygaaaccaaatcatcaaaataytcatgaccmacctcttctaaartcctaccattycttggtttcttcaaaagatcttcrgccatcca

SEQ ID NO: 693 - DNA, 401 bp, Artificial Sequence
  Consensus Reference Sequence
cctcctcrttgttgaatggagcagcttcaaaattkataatggacaagaaagttctcagaaattttgctctaccaayaacatcaragttgtccaagactgaagaattgaatttggyaaatgacaaatgacgagtyttagtattgatctttgtttctttcccaagttcttctgatctaaartaaaaatctccaccgastgatgtggctagatcatgcatgaggtcatgcatcacaaaacattcgccataaggcctactacttctatytgtacttgaacgttggaaaaayratctygaaaccaaatcatcaaaataytcatgaccmacctcttctaaartcctaccattycttggtttcttcaaaagatcttcrgccatccacaacaagattaattcatttttt

SEQ ID NO: 694 - DNA, 401 bp, Artificial Sequence
  Consensus Reference Sequence
atgttkctttcttgatatttctattttgaatttagctcctctaaactaaagactccagatttaaagagtgatgatatttctaccgttaatttwaaaaaaatggattatatttctaaaatgctctaattaaagttagtgatggccagctttctaaaatgctttaaaatggattatgttttcaracmgtgtggagcagtggtatgtgtttttttcttggtgacattaaagttgtcatagagatatgttattttataaagatctaatacsgaatyataattttataaacagttgaaataawtgatagygatttgtgtgtttttaatcaartggtaaaagatttaaatctttattaattcttataaatagaataaattttgttgggtggaaaataaaaaaatgag

SEQ ID NO: 695 - DNA, 401 bp, Artificial Sequence
  Consensus Reference Sequence
aataaataatagatactaataaaatagaatattgtgaagatgttataataataataataatataaagggagtgattaaagtaattcttttgaaatggcggcrtggaaaattattattcaattcaactctttttttatgttatatatctattataattatttgataaatacttccatgaaatttyttggttggtggattatccttcaaatcttatctatataraaatgttattattagtcargtaaaatatatttagtgagatmatctcaaayaacaatagtaaaatgagagataaagaaaatttaagtcaagcaaatgaaaagattttattatatktaaaaaawattttttctcctatcatatttaataaatataatttctataaaatataatttttattt

SEQ ID NO: 696 - DNA, 401 bp, Artificial Sequence
  Consensus Reference Sequence
gatttttttactccactatacttgctctttcctcatttttttcaaaatagacctgcctcaaaattgtttcctaaacarcactcctttttagyttgcagagagaagtmggggttaggsaacccamcttctctttgctcctattrttttttaatttaaaaaattattaaattctttttttaatattttttaaaaataatttaattgttttttaaatattattttcagataaaaaaataattaaaatttttaatattattattttgttttttaaataatgakaatattttttgtttaattatttattwatartttgaaaataattaattaataatcttaaaataaatttaaaaaacaaagtgattaaaaaaatarattgattaaaaacmcaataaatatatgat

SEQ ID NO: 697 - DNA, 401 bp, Artificial Sequence
  Consensus Reference Sequence
tttctaaaagtattccattttatttattttatgaataaggagtattaaagtgtatttcactaaaaataaataaaaaatgaaatacagtammttttttaataagatgaagtaaaagaagtgaaattatatatatatatatatatatatatatatataattttcataaatgtagtaataaaataaatgaaaatggcaatttcattgtggaaagattaaaattcaaattttagtccttraaagtgaaaaagtacgacaaattcattyatctattaactttcatccrttatctttaataaaagagcctacgtgacaccttcagagacaaatttgttagcgctcaacacattcagaggtgaaaatgaatatttayycaaratataatttaatcttcatatttttcc

SEQ ID NO: 698 - DNA, 401 bp, Artificial Sequence
  Consensus Reference Sequence
cgaaacctggtttgactcaaccrttactcggtggtctaaccgaactagtttcactattggatcggtcatgsaattgacacgggatgatctatccaaactcrgacagttagccaccggatcccggttgcaccggtccgacctaaccggttttacrcacaaaaagggaccatctctacgacatcattttgatatctcgttataatcaattgttatcttggattttgaagtatggatgaattttttttactcaaataatgttagttgtatayttatatataatataaacatatataattttgaatttttataatatattargtcaaaccagtccaatggttaatctatcarttggaccactatccattcatcaaytattttaattggatcaatgaccgaaccag

SEQ ID NO: 699 - DNA, 401 bp, Artificial Sequence
  Consensus Reference Sequence
  misc_feature 283: n = A,T,C or G
tttatyttttaaagataaacttgtaagcatgagaaaagaaaatagttattaaaaaataaaaatgaaagatctttactcattcaatgattcgagtatgagtatatagagcataacatgagaagtagacatggcaagaaaactcgtacccgtaggtacccgcccgaatycgtctcgactttgacgggtaatayccgagttgaccaggtatgggttcgggaacgrgttttccccgataaccaaaagtcgggtacgggtacgggtatragattattagacccrttcngaccccgaacccgaacccgcccgccacttaaaatttttagaatttttgcataatttaatcaaaaggcrtaaaaattttattactagttaattttattttaraatttttacataattta

SEQ ID NO: 700 - DNA, 401 bp, Artificial Sequence
  Consensus Reference Sequence
  misc_feature 139, 140: n = A,T,C or G
ttaacaatcaatttattttttctaaaatcaaatttttaatattttttttacaaaaamaatayttttctaagttgaatcgtatatggaacggsgtcggggatacccratacccgacggggatgggacaataaacttaaanncgtcgggtatcgggtacgagtatsgagatatgttagagagtcggggtaaggggttggagaaagaatacccgtacctgtcccaccccaccattgccatgtctaacgagaaggcrttaayggactggtactgcraatattcatccgccacrtggcgccatatgattgratgaccttgctactagtmacgggaagagcccgccttgtggttaggtgttgaasgatgtttggcataccatcattttcattgtccctaattcgcac

SEQ ID NO: 701 - DNA, 401 bp, Artificial Sequence
  Consensus Reference Sequence
ttgagttaaattcaagtgaagcgattgtatgcatgagtgcaaattagcttatttagttkatcagacttttyttataattcacaaaggttgttacaaaaatttaatgtatctaatttaagtatattaatgcattaaaacttatttatatatataagatatatttgttaaatttttaattgraattgtaagaaagatgaagacaagatcaaccagtaggcaaaaatcaaatcaaattcggatcctatcattcatgaggraaatcttgcccaatcataatattgagatttcaccwkattttatttgtgtgaaagattttgatagaatttttcttattcaatactactacaaagtggatastaaaaaacttagaaacaatatagagtatattaatattccttttt

SEQ ID NO: 702 - DNA, 401 bp, Artificial Sequence
  Consensus Reference Sequence
cttgacaatcaatttgtcctcaaaatgtctaaatgcttctttgcaaaaacgcaggtagagtatctkgggcatctcgtttcmggcagaggagtggaacccatgaccgacaaggtggccgccattgttaattggcctagacctcaatccatccgagctgttcgtagctttctgggcctagcaggtttttatcggcgattcatccgcggatacgctatgattgcagagccgttagttygtctcaccactatggaaactcttcagtggacycctcaykctcaacaagctttcgagaatcttaagtctgccttrgccactgcaccagttctggccttacccgatttccaggttccattcacggtagaaacggacgcttcaggcaacggcatgggagcagtcctatc

SEQ ID NO: 703 - DNA, 401 bp, Artificial Sequence
  Consensus Reference Sequence
tactagcaacttcgaacctgcttgcttcatttgtgtcatttatcctctgtttccattctttcttcttcattttggtgtcctattcaatttcacttttttcttttgttttcagttgagttttagagctgctgagggcttccatcttcaatacaygtgctctgttgtttagcattttggcgygaggctrtggtttcgggttcatgatttccgattttctgtagttgaaggttggagttttttccctctrttgtgcatgtgtgtgtttgtcagttttttgttgtttgctgattttcgtctttgcatggttgttttcttctgccacgtgytctgttgtgttttttattataaaaaaaattgttgcttttcttttcgytgccttccatttgtctgttgatcgttgg

SEQ ID NO: 704 - DNA, 401 bp, Artificial Sequence
  Consensus Reference Sequence
tttggcgygaggctrtggtttcgggttcrtgatttccgattttctgtagttgaaggttggagttttttccctctrttgtgcatgtgtgtgtttgtcagttttttgttgtttgctgattttcgtctttgcatggttgttttcttctgccacgtgytctgttgtgttttttattataaaaaaaattgttgcttttcttttcgctgccttccatttgtctgttgatcgttggattgcatttgcatggttttggattgatcatattattcctttagaggtataattctttggttctatttttttgytgtttgctaacttggctattttgtttttgtcyctttttgttggcttccatttgtgtgytgatggttggattgcatttgcatggttttktattgatcata

SEQ ID NO: 705 - DNA, 401 bp, Artificial Sequence
  Consensus Reference Sequence
ttcgccggcttccatttgtttgttgatggttgcattgcatttgcatggttttggatttatcacattattcatttagaattgrcagttctatccagctttatggcaaggattcytgacaagattaagtctattgatgggtcaagaaagrcgcttaaasttgatatgagaatcatggatctttggttcgttgggactcccaacaagtctgagcaagcggaaatggttattgttgattctgaggyatgttttttgctgtttatttggttgttggattgttgytcataccatcaattggttatatagtttgcatgttacagggtgatcaaattcatgytgtttgtaaagcggaccaactaaagtcttggaaagttgatttgaaggaaaattccacttatgttatg

SEQ ID NO: 706 - DNA, 401 bp, Artificial Sequence
  Consensus Reference Sequence
ttgaatgaacgtggaaatgatgggycgatcgttattattttgacacatgccagagtaaaagatgcgcagggtaagtgtgatgttatctttactaatttgggtgctgattagataatttttcctgttggttttttcacacttacaggaagttatccagcttcartgagcaattcgttgaaggcctcaaaattattaattaaagaacctgtattggaaatcyaggaatttagggagaggtattttggttatcccctttactatgtgcctgtcaaattggtgtatcaaytgtgttgagtgttttctggtactttttcctatttattcgattgccataggcttttagatttaggtgttgaggtcagcccagttttggcacctrgcgatcawggaagttcacaact

SEQ ID NO: 707 - DNA, 401 bp, Artificial Sequence
  Consensus Reference Sequence
tcaaattggtgtatcaaytgtgttgagtgttttctggtactttttcctatttattcgattgccataggcttttagatttaggtgttgaggtcagcccagttttggcacctrgcgatcawggaagttcacaactttyagggccaagccaattatcatcaaargatgcatttctttcaaaagctgaagccaaaactattttyaagatcaatggcatttctgaggtggtcctgttatttgtgtttattgtgtatgcattacaataaaaagcccaatttgtytagatgtgttcagatcaacatattatgtctaatgtctggygtttatttaatcctggcatttcatggttggcaatttgattgttatggttttctatcaagatgttgtttgtgttacggtgggca

SEQ ID NO: 708 - DNA, 401 bp, Artificial Sequence
  Consensus Reference Sequence
tgttatggttttctatcaagatgttgtttgtgttacggtgggcactattagcaaaatagtcatggataatcattcatggtgttatccagcttgcgttcaatgycatagaaaaattgacatcgraacaggaccattcacatgcggatgtggcaaagataatgatcagcctattctaaggtaattggagttttggtgcatcaacatctttttattcaggattttgtatttgactggtatgtacattggtaggtatagagttgaagtaatgattagccaaaacaatgacagtagcaagtttttgctctgggaccdtgaatrtgctgagttgattggtcaaacagctkatgaagtgaacagggtcaagattgaagtatgttcgtgtgttatcatataatgcttct

SEQ ID NO: 709 - DNA, 401 bp, Artificial Sequence
  Consensus Reference Sequence
gctgatactgaggtattgttttctaatgtctattttagttgttattgtcatagtgatatgatgcatgagtttgactatcgtcaacttatatatgatacakgcatgttccaaaatagatgcttcgarcgttgattgcaatgatgctacgcatgttgaatgtgtaagttaagattgttgtcatgagtgttggtytrttacatcttttaacggctgaatgaaaaaataaacttggtytgaaatttggatatattttatttaccagtttatgttttatgcarcaatctctgtctgtgacagcagatcatgatccagttgyaggattccctttaacgccaaaaaaacgtctatcatctgatgaagttgatgatgaactaggaagctcccagatttccccagcccaa

SEQ ID NO: 710 - DNA, 401 bp, Artificial Sequence
  Consensus Reference Sequence
  misc_feature 62, 330: n = A,T,C or G
tcagtcacttagtcacttggttgyatcaaatttaatttcactctaggcaataacatgttggncacaagaatatatattacatattaactttgaaaataaaatataataaaatttctaactcaactttttaawtttcttaattttcattctaatartatggtcactcattataacgacccgcctcgtcgctacgatatcatcactctaaaccgcaaagaatttyaatttttaaatgaaaactccattaatttgcttatgaaaaawtaaagtaattttaatttcacgatatacattccsaaacaacrcatcattacttaaatgaatacatanatacatatatatatatatatatatatatatatatatatatgcataataacttagtacacatcattcacata

SEQ ID NO: 711 - DNA, 401 bp, Artificial Sequence
  Consensus Reference Sequence
  misc_feature 318, 319, 320, 321, 322, 323, 324, 325, 326, 327, 328, 329,330, 331, 332, 333, 334, 335, 336, 337, 338, 339, 340, 341,342, 343, 344, 345, 346, 347, 348, 349, 350, 351, 352, 353,354, 355, 356, 357, 358, 359, 360, 361, 362, 363, 364: n = A,T,C or G
  misc_feature 365, 366, 367, 368, 369, 370, 371, 372, 373, 374, 375, 376,377, 378, 379, 380, 381, 382, 383, 384, 385, 386, 387, 388,389, 390, 391, 392, 393, 394, 395, 396, 397, 398, 399, 400,401: n = A,T,C or G
tatgaagtatgaaacatgggcaccataaagtacaatgaccatggatgaattaaagatcctaagtcatcccctccagagatgcttaaactctttaaccactctattttcccccmccagggacatccgaaaagggcaatgccccccccatgaacatacacaacatacaacrtataaaatgtgggcaccatcaagtacaytgaacatgaatgaattaaaratcctaagtcatcccctcaaagatgcttaaactctttaaccactttattttcccccaccagggacatccgacaaggacaatgcaccccccccccccccccnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 712 - DNA, 401 bp, Artificial Sequence
  Consensus Reference Sequence
gaaaaccaaaaattgtatcagatgatatttctcttcttcataaccaatctaatctactccataaactcctcttaattagacgattattaggaaagtgaaaagaaaaatataaaaaattaaaaaaataaataattcgactttgtaaaagtcataaccacattttttatcatccttctcttctccgttccctcattgttacaactgacacatttctttaacatgttgccttattttttaatcaatatgaacatgatatatcgtctctttattttctgatcatgcaattgcattratttattttctrttcttataagrattggttccacattattattatgtmatgcacttcatcatggtaygttgcactaatattaatgatsgttctacaaatctttgttgta

SEQ ID NO: 713 - DNA, 401 bp, Artificial Sequence
  Consensus Reference Sequence
gcttaggtatacctataawcactattatwaatrttataggtatagtggtttaataaacactattaatgtgtgacatgggattgaatcaaactataacattttatgaatgttttcatcattttagtctacatcactttgaaaactaaaattctaccattatgcaataaaaaaaactaaaatgacatgattataaaactcccaaggactaaaatcaaacaagtcaaattaaaaatcaaataagatgccaaattaatcactatctcagtttaatgccaataccatatcaatcaatgccgccaactatcaaaaggattaaaatctcacacttataatattcaggagactcaattaattagagaatamaattatattataatgatacatgagaaaataagtataat

SEQ ID NO: 714 - DNA, 401 bp, Artificial Sequence
  Consensus Reference Sequence
  misc_feature 89: n = A,T,C or G
acacttataatattcaggagactcaattaattagagaatamaattatattataatgatacatgagaaaataagtataattaagtcaaanttttacacataaaaamttaataaaaatcatawgtttattataaaaaaaatcattatttcatgtatatgtctcctggtagaaaaagtcttactcaaaattttatctagtgttgattttttttaatgtatcagcgttgaatwtaagaagtatgtacattttttttatttagtatcaccatatgcaattaggatcttaggttcccaataatattctaatgtatrttcataaactttgattatttgaattaattttcaattagaagtgagacttaattatacttaaaatttattatttctttyaaaaaaatgtatt

SEQ ID NO: 715 - DNA, 401 bp, Artificial Sequence
  Consensus Reference Sequence
atttattatttctttyaaaaaaatgtattttacaaaaatyaaactcaaattctaatccataaacttaacttatattatcaaatgacttatgttattaattctacctgcatattatgctttaaggttgcaaataatacaatcatgcgagaaagaaaaataaataaatttattgacgatcaatagaaattaratartatcaacaarataaatatgytaagaaaatagaaatataatttttattgatatgaaacmgtatatcatcttctataacatcatttcatgrttattgatrataaaatattaaaactgaatcacaactaaaaaaataaaatatatatatatatatatatatatatatatatatatatataaatttagatcaattataagttaaatttaaa

SEQ ID NO: 716 - DNA, 401 bp, Artificial Sequence
  Consensus Reference Sequence
tattatttctttyaaaaaaatgtattttacaaaaatyaaactcaaattctaatccataaacttaacttatattatcaaatgacttatgttattaattctacctgcatattatgctttaaggttgcaaataatacaatcatgcgagaaagaaaaataaataaatttattgacgatcaatagaaattaratartatcaayaaaataaatatgytaagaaaatagaaatataatttttattgatatgaaacmgtatatcatcttctataacatcatttcatgrttattgatrataaaatattaaaactgaatcacaactaaaaaaataaaatatatatatatatatatatatatatatatatatatatataaatttagatcaattataagttaaatttaaatca

SEQ ID NO: 717 - DNA, 401 bp, Artificial Sequence
  Consensus Reference Sequence
taatccatacgtaatgttaggtcatgcgcmaatagtaaactgtattcgaatactatctctgtgtatttttaaatttatcttaagttaaaaaartttatgttaasttaaaataagatacaacmaaaattaacatactagtttgcaaatttattttgataaataaatatatcataagataatgtacaaatatttaaacatmaaaatatttaaataataaaagatagatttaaatgtattttatattttaaatccaggcacagcaatcacgcgtgcgattggcactaactcagatggagatggctctgtcattgtcttttacctgtcgactcgacgtgattcctttayttttgcgtcaccctcgtcatcacacaacacactcacgtcataataacttctactta

SEQ ID NO: 718 - DNA, 401 bp, Artificial Sequence
  Consensus Reference Sequence
  misc_feature 5: n = A,T,C or G
ttttnaaattgctatgttatttgtgtttaatttgtakacgcacttaatgtaaaatgyttttccgtaytattatccaaatattaawttttaattgctttgttatttgagtttatygtaaaatatttttatgttttgtacaaaatcattttatcgctagattataataattattaagatgatgatgtgataaatttyytctaaaaaattgatgtkataaaataattaaaccctattgaatatttctrtcaaaatattttacaataatgagcattsattaaacttatgatgtatattattacacgtataaaaaaattggcstattattatgtatgtgrtaatyatacaattakaaatttattatcgaaatataaaaaaactaaaaaaatatatttattgattaa

SEQ ID NO: 719 - DNA, 401 bp, Artificial Sequence
  Consensus Reference Sequence
tatgttatttgtgtttaatttgtakacgcacttaatgtaaaatgyttttccgtaytattatccaaatattaawttttaattgctttgttatttgagtttatygtaaaatatttttatgttttgtacaaaatcattttatcgctagattataataattattaagatgatgatgtgataaatttyytctamaaaattgatgtgataaaataattaaaccctattgaatatttctrtcaaaatattttacaataatgagcattsattaaacttatgatgtatattattacacgtataaaaaaattggcstattattatgtatgtgrtaatyatacaattakaaatttattatcgaaatataaaaaaactaaaaaaatatatttattgattaacmtaacatatgt

SEQ ID NO: 720 - DNA, 401 bp, Artificial Sequence
  Consensus Reference Sequence
ttttattacwcaacttatgtaaaaagcatagattttggaggaaaagtattataactacatgattttactagcatatattgcaatttatattgtaatattcttgttatcygygtttacagtgtaatataaatatagatatagtacggatacagataaaagataaasatgaatattatttatacttcaatgttcggaaggttaaccaatatttaattgggtccacatagaaatcgaaattggacgmatggacgaaaaaggrcaaacctcttgacgggwgaatacgtgctcctacgttgtggctaacaaaggatactatagtaaattcatcaaaataactgtatctaagtggcgcattttccggtrctagcggtcgcaytttccattatacgctatatttcwgc

SEQ ID NO: 721 - DNA, 401 bp, Artificial Sequence
  Consensus Reference Sequence
atgattttactagcatatattgcaatttatattgtaatattcttgttatcygygtttacagtgtaatataaatatagatatagtacggatacagataaaagataaasatgaatattatttatacttcaatgttcggaaggttraccaatatttaattgggtccacatagaaatcgaaattggacgmatggacgaaaaaggacaaacctcttgacgggwgaatacgtgctcctacgttgtggctaacaaaggatactatagtaaattcatcaaaataactgtatctaagtggcgcattttccggtrctagcggtcgcaytttccattatacgctatatttcwgcgtatttatctgttcttttggatattttaatttgggtactttttttgatgaatttttta

SEQ ID NO: 722 - DNA, 401 bp, Artificial Sequence
  Consensus Reference Sequence
ctgcctccwcaaatttactaactaagtcattcaatcccttaaccattataagggacaaaaagacaccaaagaatcaccttgttyagaccrctttcatccagaaactccattattagactaccattgaccaaartagacatacaacttaagcaagttgctttaatccactttctccaarcactatcaaatycaagacagtycaacatgtaatcaaataatttatcattaacaragtcacrccatcaattaatgctacracttaaaaaagaaaactaaawtttttaacaaagaatmatataargacaaaaaaatgctaawwtttttgtctaaggactaaaacataatttaactatctaaaaaattattctcatttaagaatgtawgaaaattttattcttatt

SEQ ID NO: 723 - DNA, 401 bp, Artificial Sequence
  Consensus Reference Sequence
acaaaaatttaatctggctggatttytattgtcaaaatcatgttgaatttgaacggtgcstaatatcattattcattctgtttgggaaacatggaatgagtttgggatggtatcatatgataattccwtaataaattattgaaattaatatatatgcttmcactaatttgtcttctgacaaagttttcaagcatgcactgaatgaaaagatgattaaaagttgctcttacaattttcgttttcaaactcaagttctgtataagatgtaaacaatttagaatatgtattgacttggatcaataagtctgcaaaccttctttatttgawtgaaaatgggcattaccaagrgattcatgctcagattcttaatcctgattttttctctgttgtagttctgctta

SEQ ID NO: 724 - DNA, 401 bp, Artificial Sequence
  Consensus Reference Sequence
cwtaataaattattgaaattaatatatatgcttmcactaatttgtcttctgacaaagttttcaagcatgcactgratgaaaagatgattaaaagttgctcttacaattttcgttttcaaactcaagttctgtataagatgtaaacaatttagaatatgtattgacttggatcaataagtctgcaaaccttctttatttgaatgaaaatgggcattaccaagrgattcatgctcagattcttaatcctgattttttctctgttgtagttctgcttatgagcaatcaacgtattgtgatrtgtttcactcaaatgattctggttggagagaatgcacatcatgtgacaaggtagagttaaaaaatatatacgtattttggtacactggtagagtatatagaag

SEQ ID NO: 725 - DNA, 401 bp, Artificial Sequence
  Consensus Reference Sequence
ccgagaagaaaagaactcggaatattgggtcaaaaagtaagaggttgcttatcgatagccaggatgcgctggagctgaaacttacttgggaagaggctcaagatttgctccgtcctcctccaactgttaagccaagcattgtcwtgattgaggatcatgtatttgaagaatatgaagtaagtaaacaatttagaaggagcagtaattttatgaaattcacccattctattagtggtaggttaaattgatatttttggtgtctgtttaactcagacaccaactttgacccaaataaatatgtatgaaccttttcattctaataagttcttaatgcattcatcttaccctaaacttcttctatctaaatctaaagacaaaaatctgacttctaatttctaaaa

SEQ ID NO: 726 - DNA, 401 bp, Artificial Sequence
  Consensus Reference Sequence
aaattctttcaactacttatagtaaatatatattttttaatataayaaaaaawttgytattcatcaaatgttttcttgtttttgttttctttcctaagggagctctttagcattctcctttataaaaataaaaaaatgaattttgctttcatcrgttatgtcaaggcacaagacactaaccaatattagggctagtgtctaagcttcacaaatgtcttaatacataaatatttaaagttaagtctccactaagtctaggtaaataacattaaatttattatattacctgtttaaggttatgcacaggaattgacttatttcaattcatacaggaacctcctgtctttggaaagaggagtatattcgtagttcgatcaactgggtaagatgagtattgtaca

SEQ ID NO: 727 - DNA, 401 bp, Artificial Sequence
  Consensus Reference Sequence
agcgtgctgmtggaggcgttggagattgatcggacggatacaaatcagtatccgtgtgtttttggccgktwcaaatcggacrgcacctgatcttcgarytgtgttttctaaatttgaataaacggctgagatgcaatttgggactggagacacggatggtrraatccaattcattttcctctccaaacaaaacccaaatmasaacggtgcgttttatttgcatttttatttcttttttttattttttgaaaattgtttttatttttaaaaaattagaattttgaaaamatgtttagtttgatttcttgttttttrctttcaagagataaaaacactgaaaatatgttttcaaatggaaatgtatttttaaatttccttaaaattacattctttccyatcat

SEQ ID NO: 728 - DNA, 401 bp, Artificial Sequence
  Consensus Reference Sequence
gcgtgctgmtggaggcgttggagattgatcggacggatacaaatcagtatccgtgtgtttttggccgktwcaaatcggacrgcacctgatcttcgarytgtgttttctaaatttgaataaacggctgagatgcaatttgggactggagacacggatggtrraatccaattcattttcctctccaaacaaaacccaaatmrcaacggtgcgttttatttgcatttttatttcttttttttattttttgaaaattgtttttatttttaaaaaattagaattttgaaaamatgtttagtttgatttcttgttttttrctttcaagagataaaaacactgaaaatatgttttcaaatggaaatgtatttttaaatttccttaaaattacattctttccyatcatg

SEQ ID NO: 729 - DNA, 401 bp, Artificial Sequence
  Consensus Reference Sequence
tttcttgttttttrctttcaagagataaaaacactgaaaatatgttttcaaatggaaatgtatttttaaatttccttaaaattacattctttccyatcatgttttcattttatayaaaatgaggtttcaagtttcaactgaaaataatgaaaactaaattttattatttccagattttgatttgttttaaaaaatattttcatcaaaaatgaaaacagaaattcaaccaaacacatttytatcatcattttttatttttaataaaaatgaaaataaaaaataactaaatcaaacacccytdataatsttcatgcttcgaccaagattacttaaaaaatggtttaatatgaaactcacaatctcttttastgtctyatatgacaaatttgcaagcttaagtt

SEQ ID NO: 730 - DNA, 401 bp, Artificial Sequence
  Consensus Reference Sequence
acatttytatcatcattttttatttttaataaaaatgaaaataaaaaataactaaatcaaacacccytdataatsttcatgcttcgaccaagattacttaaaaaatggtttaatatgaaactcacaatctcttttastgtctyatatgacaaatttgcaagcttaagttaagatatacactcaaagatttttacaattcccataaayratttttaaactttatcaattctctatctcttstgttgacatctcatatatataaaggaggcttcaaawayatctattatgagttatgtttgagtttcttttsttwatttttttctgtgggcaaaaatgattattcgaamattaaatattttttaccaactagtcatmttaataagataagtaatttgcataat

SEQ ID NO: 731 - DNA, 401 bp, Artificial Sequence
  Consensus Reference Sequence
ttcatgcttcgaccaagattacttaaaaaatggtttaatatgaaactcacaatctcttttastgtctyatatgacaaatttgcaagcttaagttaagatatacactcaaagatttttacaattccsataaayratttttaaactttatcaattctctatctcttstgttgacatctcatatatataaaggaggcttcaaaaayatctattatgagttatgtttgagtttcttttsttwatttttttctgtgggcaaaaatgattattcgaamattaaatattttttaccaactagtcatmttaataagataagtaatttgcataatgagtctaacttcaaactaacgagtctcactcctattttttttatagtttgtaayaaattttactagtaactaata

SEQ ID NO: 732 - DNA, 401 bp, Artificial Sequence
  Consensus Reference Sequence
tatagtttgtaayaaattttactagtaactaataataaaaaaaaagtgttaaaagaaaagtatttaacwgtattttgatatcacttttatatcratatatactagtattttaacccatrcaatgcatataataattttttattttatatgactaaaatttataaagaataaatatatttgaatatataaattatattgtcattattgaaaataatccaaatcccgcgttgactaacagtaatcttacattaaaatatataaatgagggacaacyctcrttccttgataaataatttatattgtagtaaatttatttttaattattacttatttcaattaaaaacaaatttatattagaaataaagataaaaaagataacttaaaagagataagatgctcat

SEQ ID NO: 733 - DNA, 401 bp, Artificial Sequence
  Consensus Reference Sequence
  misc_feature 365: n = A,T,C or G
gaaaataatccaaatcccgcgttgactaacagtaatcttacattaaaatatataaatgagggacaacyctcrttccttgataaataatttatattgtagtaaatttatttttaattattacttatttcaattaaaaacaaatttatattagaaataaagataaaaaagataacttaaaagagataagatgctcattttttaaaaaaaataaaaaatcaaatttaaccaaaaaaacaaagtctttatgcatgaatatataaattatattgtcattaaaaattataataataaatatatttygacatattaattatgatttatatcttatgataaataatttatattrtggtaaatttatttttaantattacttatttcaattaaaaaccagtttatattga

SEQ ID NO: 734 - DNA, 401 bp, Artificial Sequence
  Consensus Reference Sequence
cattaacaccaaaaggtatttggctctttttgttatcttttggctgttataakttgtttgatttgtatttttattttttgttttcatttttcgaaaaaaaatttcatttttaaaagattagaaattttaagaatatgtttgatttgatttcttgttttctgcttacaagaaataaaaakactgaaaatgcgtttttaaaaaaaaatgtatttttagatttgcttaaaattacattctttgtcaccgtgttttcattttactcaatatgagattcctgattttarctgaaaayactgaaaataaaattttattgtttytaattttttgttcgtttgaaaaaatattttaaaaaatttaaccaaacgcatttccatcattattttctatttccaataaaaata

SEQ ID NO: 735 - DNA, 401 bp, Artificial Sequence
  Consensus Reference Sequence
tcatttttcgaaaaaaaatttcatttttaaaagattagaaattttaagaatatgtttgatttgatttcttgttttctgcttacaagaaataaaaakactgaaaatgcgtttttaaaaraaaatgtatttttagatttgcttaaaattacattctttgtcaccgtgttttcattttactcaatatgagattcctgattttaactgaaaayactgaaaataaaattttattgtttytaattttttgttcgtttgaaaaaatattttaaaaaatttaaccaaacgcatttccatcattattttctatttccaataaaaataaaaacaaaaaaaaaatcaaattaaataccccttaatttttbatagtgcaacaccaagggcagtgttgcttygagcaacagagt

SEQ ID NO: 736 - DNA, 401 bp, Artificial Sequence
  Consensus Reference Sequence
cgaaaaaaaatttcatttttaaaagattagaaattttaagaatatgtttgatttgatttcttgttttctgcttacaagaaataaaaakactgaaaatgcgtttttaaaaraaaatgtatttttagatttgcttaaaattacattctttgtcaccgtgttttcattttactcaatatgagattcctgattttarctgaaaacactgaaaataaaattttattgtttytaattttttgttcgtttgaaaaaatattttaaaaaatttaaccaaacgcatttccatcattattttctatttccaataaaaataaaaacaaaaaaaaaatcaaattaaataccccttaatttttbatagtgcaacaccaagggcagtgttgcttygagcaacagagtcgtgcatc

SEQ ID NO: 737 - DNA, 401 bp, Artificial Sequence
  Consensus Reference Sequence
ttattaaaaatcataaaattcatgtgtgtgaagtcattttaagtttttacttgaaatgaaggatacagtataaataagctaaatataatttcttctaaacacgccttgaatctgaagtctattgataaaattgattcacacaagtcgatcgrttcatcactactgctttctagttttcacatcggttctgagtgatarttaggatggttggttaacagatgtatggtgcgattcaagtttcaaaaacttcattaattagttasttctggacaaaatgctgataaatgctatcgtctgatattgaataccagcaacatacttgataaattgtwaattaattttttatataatgcttgatcackcattacatagtcacacacacatataatggccagtgtata

SEQ ID NO: 738 - DNA, 401 bp, Artificial Sequence
  Consensus Reference Sequence
attgtaattctatgaaatctatcttggtgagtggtgttttgatatcactatagggacatgttgattgttgtggtgtaggcatgaatggtgatctagtactaagtgtgaacgtgcgataatgwgcattatggtcttagccctatagattttgggatagccataagtgatggtgtgatgatggtttaataatgacatcaagaawatcataaaacccttcaaatagaccaagccacaaaaatgagctttttggtcaggtcttyaaaatagattatcggattttaaaaattagactataatagaaaaatacgtcatacttaaattcataattatsaaycatgctaggtttaggttcatcaaatcctagttcaacttgatttttttcactcataagttatgttatt

SEQ ID NO: 739 - DNA, 401 bp, Artificial Sequence
  Consensus Reference Sequence
ttttttttctataacaaagactaataatgaccaataaatcaatattttagggatatttttataagagaaaatttaaagatcaaataaaaaaatttagataaattataaggaccaaaaatatatttaagtcaataatataatatcataaaataaaataaaataaacaataacttataatctttaatattatatattttaggctattttttcagtaaacaaaatattgtatattttaattataatttaatcactttgtttaaaatgattttcttctataaagttgtgttgtttaaatgttttctttttcctctaaatactttgcaactaaaataagatatgattatcattataryaattttgttgtatttcacattttcacactaaaaaatttggtaaataaa

SEQ ID NO: 740 - DNA, 401 bp, Artificial Sequence
  Consensus Reference Sequence
tcgttttctcktattcatgtcataatgtagggaaacttaaccatattgtaattcataaaagaaatatttaaagcaattatttaaaataatccacaaatgaaaaacactggtaatgctaacagctctccactactatttatattttttaaataaaagcatttataaattataaatctaaggtacaaatagaaaataaaaaacatattactttttcataaaaatggtattactttaatagtaaaatatttttaaactcctcgactaatatccaatcatacactaagacaatrcggtacaaaagtacttctcaatccayatgtatttatccttaaatatacgaataaatkattaaaagatatataactccasaattcatgacagttttgcataaattagatatt

SEQ ID NO: 741 - DNA, 401 bp, Artificial Sequence
  Consensus Reference Sequence
ctaacagctctccactactatttatattttttaaataaaagcatttataaattataaatctaaggtacaaatagaaaataaaaaayatattactttttcataaaaatggtattactttaatagtaaaatatttttaaactcctcgactaatatccaatcatacactaagacaatrcggtacaaaagtacttctcaatccacatgtatttatccttaaatatacgaataaatkattaaaagatatataactccasaattcatgacagttttgcataaattagatattttttactgagcacaaattagattttaaaaatgttttcgagaattcgcaaggtgacaaaagacatcaacaatattttttaacattttcatcctataatttccaaatcgttttcaga

SEQ ID NO: 742 - DNA, 401 bp, Artificial Sequence
  Consensus Reference Sequence
ataaatctaaggtacaaatagaaaataaaaaayatattactttttcataaaaatggtattactttaatagtaaaatatttttaaactcctcgactaatatccaatcatacactaagacaatrcggtacaaaagtacttctcaatccayatgtatttatccttaaatatacgaataaatkattaaaagatatataactccacaattcatgacagttttgcataaattagatattttttactgagcacaaattagattttaaaaatgttttcgagaattcgcaaggtgacaaaagacatcaacaatattttttaacattttcatcctataatttccaaatcgttttcagagcttcaccttcagccaacatccacacacatcaacagaaaataaattttttcta

SEQ ID NO: 743 - DNA, 401 bp, Artificial Sequence
  Consensus Reference Sequence
aaacatgtcttagaatggaggcaaatatctaaaccaacttgagttcttacacaacaagatcaactgcataatataaacaaacctttctatttccttactctttcaaaaagtttatcaacatcattgttctacaccttagataattacttgtaawagttgctatgagaactcttttatttacagcaaaatgatttttttttaaaataaatttacaactctcacggttagcttttggtcctcttggaagaaaacaagtgccgaataaacgaaaactttaccttatttcgggtagaaaagtcagttatrgtaccgttacttgttacrgcctcaggtttgttctcaggttctggckgcaacgwaggggatggttgttggagtgtgaagagaaactcattgagtaa

SEQ ID NO: 744 - DNA, 401 bp, Artificial Sequence
  Consensus Reference Sequence
gtcatttgattgcaaatataagtatttataatattaaaaatagattagaaagagaaaatatatttaaaaagaaataagtaacactcaaatattttttttwaaaaaaatagcaaattaactatttttacaatgaagattataaagaatacttccttccgtcttgactgtaagaaaaaaaawtttcatatttattaaaaaaaatgataaattttattaaattgtgtcattttaaattaaatatataayagacatttttcctaaatcattatttattaaaacttgatattaagtataaaaaaatatttttttattaaatgaaaaatattttagmragagatacaagaatagagatttgtttatatttgacacaaataagagacttttattacttatattcatga

SEQ ID NO: 745 - DNA, 401 bp, Artificial Sequence
  Consensus Reference Sequence
  misc_feature 128: n = A,T,C or G
attttsgagataatattcttggagggagaaaaargaatctcatgaagacagtacaagtgraggtttcaatctcttctccgtctctctgacatttgrgaattctatcggagcagtcggagkaataactnaagraatctcagggaaccgctatagatgttactatcgttggctgaagacacgtgagtccgctcagaggtaagagatgagtttatcgcaattggggattakaatgaacatgtgtagggatccttagagaactaaagttgggtttattttgggatgtttattgaattataattttctctttatgattataaatataatattattgtgttctatgtaccaattgatgtcctgatgagaattgattgataaacttgagtgctcttgatgtctttgtg

SEQ ID NO: 746 - DNA, 401 bp, Artificial Sequence
  Consensus Reference Sequence
tgtattattatgttttgatyggagtgtgtgattcytgtgtataatgattgatgattgaaatgtgtgattgatggatgaaaagtgtgattgatgaatgacaaartgatgaaataatgtgagatatgctaagtaaattgtatttgactactatatgttgtgttgtttctctctagtagttagmaatgtgataactcactcccagtttgctgtttgtgtttggatcctgtgatgatcttgaactttgtgttcgggggagcagatgaataggtggatgactatgaagaacctcatgctagaggacacrggaacaccaygctctgataggatgtgacattaggatataggttctatattaattgtatgagacttakatgactttctttgagtcgagatgactttat

SEQ ID NO: 747 - DNA, 401 bp, Artificial Sequence
  Consensus Reference Sequence
acataatcttacatgagtcaaccctattaatragtcaaccctattcattagatttttactcttactatatcaattttattagcaaaatctttagtatttttaaccasctaaaggtattttatttttaataaatgwattgaatgcataatattgaatgtaaatcttgacaaatatatgataataaaaaaggaatttgaaatcttgaaattcaaagggggaattattgtaatgcataatttaaatattcaattaaaatttwaaagtgagacttcatttkyttttagactgaatcaaataattagctagttttgaatataactttggatatatctttaatttttcactttacacatgtttttttacattaaagttaaatttkaaaaygaatttatcstttaaaa

SEQ ID NO: 748 - DNA, 401 bp, Artificial Sequence
  Consensus Reference Sequence
agaccaagcttggaaatcaatgaattgaaggagggagcaggcartggcttggtaagtacatctgscaattgtgcaacagaagaaaytggcaggagatgaatgaggccartttgtattttctcacgaatgacatgacagtcaatttcaatatgttttgtcctctcatggaagatggggytgtgagcaagatagatagcacttttattatcacwgtaggctgagataggttgatcaagagagatgtgaagatccttgaacaaataytgcagccattstaattcacaagttaagctagccaaagctctatattctgcttctgaacttgacctrgatattgtggactgctttttggatttccaagacagcatagatgtgccaagaaagacacagtaaccagtcac

SEQ ID NO: 749 - DNA, 401 bp, Artificial Sequence
  Consensus Reference Sequence
ttctataagagaactaatggacagacaaaaaygtttgtgacatggactacatttgtcatatgatagtatagaagaaagagggtaaggagatttacctggattagatgctskcagcattgaggatagcaaattgcagtggtattcagagagataagmaggaggttttgttagtctatgtgattttctggttggtgcaggaggggaggtaggttcatttggtggaggtaaggatagtggaagatctaggagaatgtcagatgtgtctaagttagtaatatcagggttgacactracagrattattggcaggkggaggtgaggcaaaaggaaagacagtttcatggaagattacattccttgaaacatagaactcatgggtgataggatcataaagaaggtagc

SEQ ID NO: 750 - DNA, 401 bp, Artificial Sequence
  Consensus Reference Sequence
agtaataaaattgaaaacagttcctgatattgcaattcatccctcactttagttcaaattcaaaaaatcgtgtgatttargtggacttcaaaaaaataaaataaataataagtggwtaagtttagaaatttatttttcttcaaaaaaaataattttgraaacttatttgacaatataagaatttatttttaaatttcttatcttaaagggattaatgcgaccacgcttacacaattaatgactcaaatatggtartttatcctattttgaaatattacaagggaattattttgaaawaatttactaatatggaattatttgtcatatcattatcaaatmgtkaattgacaatttctagtgtcttgtgattyttttaaataaaatgaactarcagtcacata

SEQ ID NO: 751 - DNA, 401 bp, Artificial Sequence
  Consensus Reference Sequence
  misc_feature 368: n = A,T,C or G
caaattcaaaaaatcgtgtgatttargtggacttcaaaaaaataaaataaataataagtggwtaagtttagaaatttatttttcttcaaaaaaaataattttgraaacttatttgacaatataagaatttatttttaaatttcttakcttaaagggattaatgcgaccacgcttacacaattaatgactcaaatatggtagtttatcctattttgaaatattacaagggaattattttgaaawaatttactaatatggaattatttgtcatatcattatcaaatmgtkaattgacaatttctagtgtcttgtgattyttttaaataaaatgaactarcagtcacataaatcatatattatcatttgantttgaaacgcattagttcaggtggtaacttcta

SEQ ID NO: 752 - DNA, 401 bp, Artificial Sequence
  Consensus Reference Sequence
agattatttatcwtaaacaatttcatgtctaataacttgttttacttttgaagtgaaactagtaacttggtgtacaatatcctcacaagtactgcataatcagtaawttttgccagttgaattggagagytctattcaaagtagccaagtatcattgagggtggtgtcaccttaattagccagcaattttcacaaacaaattacacaatatgatgcactaggtkttttttttttacaaaaaaaattgccacatcatatgatgatattcaagtagttttaatttattttttcaaaggagttgacactcasgtgtcmtgctacatgagatacactagtcyaatcataacaatataaaagttgctaattgaatttacacattctaagtaggttcttamttcaaa

SEQ ID NO: 753 - DNA, 401 bp, Artificial Sequence
  Consensus Reference Sequence
  misc_feature 309: n = A,T,C or G
catcatatgatgatattcaagtagttttaatttattttttcaaaggagttgacactcasgtgtcmtgctacatgagatacactagtcyaatcataacaatataaaagttgctaattgaatttacacattctaagtaggttcttamttcaaaaaaaaaaatggtcaatctatatggctattttgataataatgtaacaatatcaactctaaatttttttgtacatactttatgatttaatctctgttatgttaatcaatcaaaaagattaagttagcggacaaaagctttttagtttgagaatttgaganatttagttgcataagtcttttttgttctaagaaaaagaatacttcttacctcattattcttttttcaacaacccaccttttgaatataagta

SEQ ID NO: 754 - DNA, 401 bp, Artificial Sequence
  Consensus Reference Sequence
  misc_feature 51: n = A,T,C or G
tataaattattcaaaataaatattgtaccaaaataccaaaatataataaanaatgtaataattattataaatttatcyaaattataataattagtcacaatctattataaataaaagataaatttatctcatatttcacttyttygaatcttggtgytaggcagtcttggtatgrgtatgaagctcatgtaatttgattggttcttgttatgagatacttcatctgggattataattcaaattggtgctaaagrcctaactrgaggtggtctgaacacaattgacattggtggaggtacgaagattgtttcatayagcaataataaatarcrattagttatrcataacatwatttaacattaattaatcaattaaatgtaaaaatcactcatatgacttgg

SEQ ID NO: 755 - DNA, 401 bp, Artificial Sequence
  Consensus Reference Sequence
tgtaataattattataaatttatcyaaattataataattagtcacaatctattataaataaaagataaatttatctcatatttcacttyttygaatcttggtgytaggcagtcttggtatgrgtatgaagctcatgtaatttgattgrttcttgttatgagatacttcatctgggattataattcaaattggtgctaaaggcctaactrgaggtggtctgaacacaattgacattggtggaggtacgaagattgtttcatayagcaataataaatarcrattagttatrcataacatwatttaacattaattaatcaattaaatgtaaaaatcactcatatgacttggagttggaacactttgagctsgagcactttcagcattargagtttgagtaattt

SEQ ID NO: 756 - DNA, 401 bp, Artificial Sequence
  Consensus Reference Sequence
tgcaagcaaactcacacaaccaaaaygcaacraygacgacaccattacgccgacgatagcaacagtgctgttaygaccaaccaaaatkrcatacrcgtacaagaaaaaattgaagaaaagcgcgaacaagaacaaaygaaaaaatggaagagccagcgtgaagaatgcaaacttgggtaagcatgaagaagaacaacaaccaatrtttggraaatgaagcaatggaagggcgcaagaagaagaacaagagccaacgttaaaaaaaggaagcaccttggggaagccagaagaagaaaaaaaatgtttgggaaagaaagcmaraagaaaaagaggtataaacaagygtgaacaatgaatttttatttgaaattgttaatgccacaaatattcctattycaaag

SEQ ID NO: 757 - DNA, 401 bp, Artificial Sequence
  Consensus Reference Sequence
atggaagagccagcgtgaagaatgcaaacttgggtaagcatgaagaagaacaacaacmaatrtttggraaatgaagcaatggaagggcgcaagaagaagaacaagagccaacgttaaaaaaaggaagcaccttggggaagccagaagaagaaaaaaaatgtttgggaaagaaagcmaraagaaaaagaggtataaacaagtgtgaacaatgaatttttatttgaaattgttaatgccacaaatattcctattycaaagtgtgggaatataagtcaataaaatgttacwtgataaatatgtycctttgtgtcatgttgatatttttgtcastgacaaatttgtctctttgtgttaacgrtcggatatatttatyacactttttacacttttgaarattaaat

SEQ ID NO: 758 - DNA, 401 bp, Artificial Sequence
  Consensus Reference Sequence
aagtgtgggaatataagtcaataaaatgttacwtgataaatatgtycctttgtgtcatgttgatatttttgtcastgacaaatttgtctctttgtgttaacgrtcggatatatttatyacactttttacacttttgaarattaaattttatatttacatcttttaagratatatttgttaaraaattacacattcaaaaataaaagtagttatttactctaatttgcgtgagcagagatcaagatattggtacctacattttcaaattccaatccagaaaaaagcacagccaatgataaattaagttmaaaagggttgaaaatatgcacacataaagacargagtaaatctcaaaaatcttcaaatataaacaaatgattaaaatcacaaaactcttgata

SEQ ID NO: 759 - DNA, 401 bp, Artificial Sequence
  Consensus Reference Sequence
agtttccttggggatattgtaatagaagaacaagaagtcatgggaaaactttytttttgaaagagattgatctaataagctccaagtccaatagggtatttgatgttgaacaacaagcagcwagtgatgatggagtttgtgttagtgttgaagaaggtttttagaagaaggctttatatataataaaggggaattgggtttgaagagggggaataaagagagagagagagagagagagagagagagagagagagagagagagagagagagagagagagagagagagagagagagagagagagagagagagagagagagagagagagagagagagaragagagagagagagagagagagagagagagagagagagagrgrggggggggggatatggtttttt

SEQ ID NO: 760 - DNA, 401 bp, Artificial Sequence
  Consensus Reference Sequence
  misc_feature 114: n = A,T,C or G
gagagagagagagagagagagagagagagagrgrggggggggggatatggttttttattttatttttatgatattgttattttgtattattttattgctgtgagaaaaaaaarnaaaaatataaacatgggttttgggccatatggaatcacgaatagtgggtggaaacttgatgataaaaaaaaattgaaaaatgaaaattaaaaagatatgagtgcctcctctttacgatggcaaagtacaaacacaccagctaagctttctctstcttcattgcacaaaaaacaagacaatgtcttacaccatgttcttcacaagttttgggtgcatgaatgacccttaaattgtagccattgattttgtttttttaaataatcaattgcaagaagcaataacctgga

SEQ ID NO: 761 - DNA, 401 bp, Artificial Sequence
  Consensus Reference Sequence
aaattttatgcaaatttgaacaacagacatttgtttttgatattttggaaaatctaaagtaaytatcactcaaaagttaaagattgatattttaaaatattaagatttaatyaaaagattaattttttagtgaacatatacctaagaaataargttatatctgtcaatttatcaagtcacattgatatatgtgtatctatggatgaaacattaaaagaagaatagaatagtaagcaaacgtggagytggctcatgacccagtcmttattttgcttttacaaaagaaaaatgtttgttttactttactattttktatacaatattttatataaaagaaggaaaagactggaaaataaagtaaaaaaacaaggtaaataaacaatgtagatgaaggcgataaa

SEQ ID NO: 762 - DNA, 401 bp, Artificial Sequence
  Consensus Reference Sequence
tggaaaatctaaagtaaytatcactcaaaagttaaagattgatattttaaaatattaagatttaatyaaaagattaattttttagtgaacatatacctaagaaataargttatatctgtcaatttatcaagtcacattgatatatgtgtatctatrgatgaaacattaaaagaagaatagaatagtaagcaaacgtggagttggctcatgacccagtcmttattttgcttttacaaaagaaaaatgtttgttttactttactattttktatacaatattttatataaaagaaggaaaagactggaaaataaagtaaaaaaacaaggtaaataaacaatgtagatgaaggcgataaaaaataatattatataaataatrttcttttttacaaatttaagtaa

SEQ ID NO: 763 - DNA, 401 bp, Artificial Sequence
  Consensus Reference Sequence
ccttcttcttgtcgaactttaatgtagcaaatgtaacatcgcagaatcctccaataacaatgttatatagctggcagattattgagtgggtgtttgggacctacaaaattaaagcacacctaaatgtaactataatcwaacaaawtgattaatattttaacaaatacatgctagtttacattcaatacatactaattcacgtgaagacaggaggaaagtgtywttttcgtttttaaattgagtattgatcattgtcctttgccttgaagatttgtgctgtttgcgactccctgtagcawttcatgcgtagaactcatagttataggagaaaatttaggtagtccaaaatcattacgtakttacgattttatctaatttttgagtcacacatactcaaaatt

SEQ ID NO: 764 - DNA, 401 bp, Artificial Sequence
  Consensus Reference Sequence
  misc_feature 232: n = A,T,C or G
taagcttaccacrtgcattatcctcgtaatcttcttcgttcttgtttcttgcatccttctcggggggagggagaattctagtacatagagcctytgcttcattactaawagattatttttaccagcgaaggaaaaattrgtatttaagatttacagaaatatgagatgtatgtactttaatctttacatcaacttctcctgttgtttaatttaagatctaatctcttttcanaaaaaaaaaattaagatccaatctagactgttttatatttrtacatgaatctagattgttgttgaaaaatagattattgtttaatttagtagttgaaaratattwaatgtaaaagattgahccgttttaagaattggagcggcatgccacgaataaacttccaacttyt

SEQ ID NO: 765 - DNA, 401 bp, Artificial Sequence
  Consensus Reference Sequence
  misc_feature 160: n = A,T,C or G
gaattctagtacatagagcctytgcttcattactaawagattatttttaccagcgaaggaaaaattrgtatttaagatttacagaaatatgagatgtatgtactttaatctttacatcaacttctcctrttgtttaatttaagatctaatctcttttcanaaaaaaaaaattaagatccaatctagactgttttatatttgtacatgaatctagattgttgttgaaaaatagattattgtttaatttagtagttgaaaratattwaatgtaaaagattgahccgttttaagaattggagcggcatgccacgaataaacttccaacttyttaccttgtgatrarattgacccattacaccatgtcaccatttaatacaattattttgccatgtgagatcgta

SEQ ID NO: 766 - DNA, 401 bp, Artificial Sequence
  Consensus Reference Sequence
kttttrtaaaagttattccaaacacttctttagaaaacacaactcaataatcatttattttttttkaagttaaaccatgttgcatatattaatcaaggctgagaaagccaataatacatcatggtttaccmtggattggatgtgagatggaatatcctcaatccaaaccgaatcaaaagatgaaaaagcaagtgtagcaagactatgagctacgttgtttcctactcttttygtatgctctattctaggtagytrtgagtttcccaaaaagtgtttcattcaaaacctttacactccaaaagaaggtctttcgctatttgaaggctcaatctaagggmcattgcttctgcaatctgatgaggttagaagcatgaaggatcaaaagaggttgcagcagccat

SEQ ID NO: 767 - DNA, 401 bp, Artificial Sequence
  Consensus Reference Sequence
atttattttttttkaagttaaaccatgttgcatatattaatcaaggctgagaaagccaataatacatcatggtttaccmtggattggatgtgagatggaatatcctcaatccaaaccgaatcaaaagatgaaaaagcaagtgtagcaaractatgagctacgttgtttcctactcttttygtatgctctattctaggtagttrtgagtttcccaaaaagtgtttcattcaaaacctttacactccaaaagaaggtctttcgctatttgaaggctcaatctaagggmcattgcttctgcaatctgatgaggttagaagcatgaaggatcaaaagaggttgcagcagccattatctctccttgacaatttctaaatataacacccatatctgtgcctcttccg

SEQ ID NO: 768 - DNA, 401 bp, Artificial Sequence
  Consensus Reference Sequence
  misc_feature 24: n = A,T,C or G
taatatttgttttgtagaaaaaanyaatgtttttaaaaattaatagctagggttcatgactataattttgattgcaacattaagattttattktagtgtcctggattgtaattgaagttgcatcattcactttaatttgtcrgcaatatcaaaaaacaagaaattgctaccataattacaatttaaaactttggcaataagaattrggcgtggtagtatatgaagagaaaatcaaagtctggatggagaactttgaaaaggacatgccactataaaagagctttttatttaaaaataataattttwtaktttttagtttttttttaactaaaaaaactcaaattttttcacatttttttcttttacatttcatttamacgtacttttctttttatatctcc

SEQ ID NO: 769 - DNA, 401 bp, Artificial Sequence
  Consensus Reference Sequence
  misc_feature 19: n = A,T,C or G
tttgttttgtagaaaaaanyaatgtttttaaaaattaatagctagggttcatgactataattttgattgcaacattaagattttattktagtgtcctggattgtaattgaagttgcatcattcactttaatttgtcrgcaatatcaaaaaacaagaaattgctaccataattacaatttaaaactttggcaataasaattgggcgtggtagtatatgaagagaaaatcaaagtctggatggagaactttgaaaaggacatgccactataaaagagctttttatttaaaaataataattttwtaktttttagtttttttttaactaaaaaaactcaaattttttcacatttttttcttttacatttcatttamacgtacttttctttttatatctccggtca

SEQ ID NO: 770 - DNA, 401 bp, Artificial Sequence
  Consensus Reference Sequence
ttgtaattgaagttgcatcattcactttaatttgtcrgcaatatcaaaaaacaagaaattgctaccataattacaatttaaaactttggcaataasaattrggcgtggtagtatatgaagagaaaatcaaagtctggatggagaactttgaaaaggacatgccactataaaagagctttttatttaaaaataataattttttaktttttagtttttttttaactaaaaaaactcaaattttttcacatttttttcttttacatttcatttamacgtacttttctttttatatctccggtcacatcttttttttttcttcttatcttgttttttttcttctctatctttcatacacasatctcacatttcacgagtgtgagaaaattattattttttaaaaa

SEQ ID NO: 771 - DNA, 401 bp, Artificial Sequence
  Consensus Reference Sequence
taattgaagttgcatcattcactttaatttgtcrgcaatatcaaaaaacaagaaattgctaccataattacaatttaaaactttggcaataasaattrggcgtggtagtatatgaagagaaaatcaaagtctggatggagaactttgaaaaggacatgccactataaaagagctttttatttaaaaataataattttwtattttttagtttttttttaactaaaaaaactcaaattttttcacatttttttcttttacatttcatttamacgtacttttctttttatatctccggtcacatcttttttttttcttcttatcttgttttttttcttctctatctttcatacacasatctcacatttcacgagtgtgagaaaattattattttttaaaaatta

SEQ ID NO: 772 - DNA, 401 bp, Artificial Sequence
  Consensus Reference Sequence
  misc_feature 173: n = A,T,C or G
tttttcacatttttttcttttacatttcatttamacgtacttttctttttatatctccggtcacatcttttttttttcttcttatcttgttttttttcttctctatctttcatacacasatctcacatttcacgagtgtgagaaaattattattttttaaaaattayttcttngaaacatcaagaatatattgcttttwctgtaaaaaaaagaatatattgctttttctgtttgactaaattttgtctttagtgagtgaaattaaataaccttaattattttattaaatttagaatattcaacagcttattttaatttttgtaaaaaaaaaamagattattttaatttttaaacataatcttgaatgacaatcattttgagactgaagggagggagtaatt

SEQ ID NO: 773 - DNA, 401 bp, Artificial Sequence
  Consensus Reference Sequence
tttttctgtttgactaaattttgtctttagtgagtgaaattaaataaccttaattattttattaaatttagaatattcaacagcttattttaatttttgtaaaaaaaaaamagattattttaatttttaaacataatcttgaatgacaatcattttgagactgaagggagggagtaatttatgtaacaaagttcgcacgttgacwcctttgatcctttaattttctttttcccacattgtagttttttttggtagattttctcaatttaatttaawgtttaagctayaaacttgaaattgttagttctcyaataaatataatgtttttttcaaataactgaaaatggctgttgaaaagtgaataattgtgcagattaaattatttttaaagtttattattg

SEQ ID NO: 774 - DNA, 401 bp, Artificial Sequence
  Consensus Reference Sequence
  misc_feature 105: n = A,T,C or G
ggatagagcaactaaaatttaagttttatartcatcatcaaaaaaaktattagtttttataaaacaaaaaagtctcaaatstacctaaaatattcctatataatnwtaggaaaataccttccaaaattaatgtttaattttttatatcctgaaatacaaaaatttaaacatcattttaagatgtaytttccagacagacatacaattataggtcytgaaaaatattttcytgaatacaattttaagtttgtattcargaaagtactttttagawgtcaaaaaattttaaaaagtaytttttggaatttaataaaaaarratatgttacatttattytaaaatctaaaaagatratmatttcaataaagtgrcagataaakaaagtattaatgtctwtactc

SEQ ID NO: 775 - DNA, 401 bp, Artificial Sequence
  Consensus Reference Sequence
acacaamatgtgtaaaycatgtatgaagattcaaarcttgtaaatacttttcctaatktgtattaagataataaagttatcaaataaktaaayccaagaaggtgaggaagaaadgaatgttttgttgtcatgaaagtaaaaattggartsaaaaaaaggaaagattctaatgaaagaaaggraaaatattttgttgtcctgaaaggagtgcattgttgggagrgrgggggggggggagtgtatgatggtgtgaggaaaataaaaagatttdagatragactcctctttgtttttgtggaattatgacaatcggtagrgtcctataatatctttcctcgtatmtatattttgaaaaaaaacacctrtagccgatgtcatacctgtgcgggtaacaactttaa

SEQ ID NO: 776 - DNA, 401 bp, Artificial Sequence
  Consensus Reference Sequence
rgrgggggggggggagtgtatgatggtgtgaggaaaataaaaagatttdagatragactcctctttgtttttgtggaattatgacaatcggtagrgtcctataatatctttcctcgtatmtatattttgaaaaaaaacacctrtagccgatgtcatacctgtgcgggtaacaactttaatcttcattttttacttccatggcaacaaatcattcctttgracctcacattcttggtttagytatctaatagatttattatctttctacaaactaggaaaartgcttacaagctttgaatattcatatatggtttrcacatgttgtataattaggttagakattyaagtaktggagtatagatacawtgaatgctttctttgtctgtcactaattatcatct

SEQ ID NO: 777 - DNA, 401 bp, Artificial Sequence
  Consensus Reference Sequence
tacaagctttgaatattcatatatggtttrcacatgttgtataattaggttagakattyaagtaktggagtatagatacawtgaatgctttctttgtctgtcactaattatcatctttttggattttgraataaatgcaacatgtkttttttccattaaggtctagaaattacttttcaatttttttttacttctagaaattactttycraaatacaaaattaaaattgcattcaagaaagtattttctaraacttataattatgtatttgaaaaggtacattttgaaattgatrtttgattttttgtattycraatgaaatataaaaaattaaatatcaattttagaatggacttttytaaatgatgatayagaggtataatgaatatttatacyagtaa

SEQ ID NO: 778 - DNA, 401 bp, Artificial Sequence
  Consensus Reference Sequence
ctttattgccaaacaataaccattggcggaaaaagcacatttaaggtccaacacaaaggttactggctcctaacctaaaagatggtgggaactgattgggacactaaaatactggtacatcaacattttttttaaataccaaaaatgtccttaygaatattttttattacaaatagcagatcagyttttttattwatgcagtgtcttcttttttttttaaatctcactcccttaatataacttaatgtaacttgcttarcatctttatgtgagtgtttgttgtbtagtggtgcatgtaygttgttttcggatatacgatraagttcattgattttttcatcgccrgagaagaacaagttcatattaaaaaaattcaaaacatacatattgataatcyagat

SEQ ID NO: 779 - DNA, 401 bp, Artificial Sequence
  Consensus Reference Sequence
  misc_feature 309: n = A,T,C or G
tcaacattttttttaaataccaaaaatgtccttaygaatattttttattacaaatagcagatcagyttttttattwatgcastgtcttcttttttttttaaatctcactcccttaatataacttaatgtaacttgcttarcatctttatgtgagtgtttgttgtbtagtggtgcatgtaygttgttttcggatatacgatgaagttcattgattttttcatcgccrgagaagaacaagttcatattaaaaaaattcaaaacatacatattgataatcyagatggttcatacggattgtcaatccatatnttttgaatttttwaaaaaattataatttttttatamtcttttttatacatttaatttatttacaaaatttgataattaaacaaatttgatat

SEQ ID NO: 780 - DNA, 401 bp, Artificial Sequence
  Consensus Reference Sequence
  misc_feature 57: n = A,T,C or G
aataaataataaatgacttgcctcgagccaacacagagggttaaacaaattatcccntcaattcaattaaaatttttwaaaaaawtatttttttaaaaagaaagaaaattaaacaaagaagcattttwwaaawaaataaatttgaatagattaaaaaaatatyagttaaattaawttttttcaccatccacaacaacacctrcaacaagacatattactacaatraatttacatataataacaaaattttaaaaaataatattacaamacaatagattattttcktmagtgagttwgattgatcaactttgaaatctgaaaataatattgttggycgaattgttcaagctggttatgagttgtgctggtttgcacccatcaactttgaaatctgaagcaga

SEQ ID NO: 781 - DNA, 401 bp, Artificial Sequence
  Consensus Reference Sequence
taaaatttttwaaaaaawtatttttttaaaaagaaagaaaattaaacaaagaagcattttwwaaawaaataaatttgaatagattaaaaaaatatyagttaaattaawttttttcaccatccacaacaacaccyrcaacaagacatattactacaatraatttacatataataacaaaattttaaaaaataatattacaacacaatagattattttcktmagtgagttwgattgatcaactttgaaatctgaaaataatattgttggycgaattgttcaagctggttatgagttgtgctggtttgcacccatcaactttgaaatctgaagcagaagcccaggaacaagarcaagctaacatgraacattcacccatttcacaaccaatcaccacaaggtag

SEQ ID NO: 782 - DNA, 401 bp, Artificial Sequence
  Consensus Reference Sequence
atttcacaaccaatcaccacaaggtagcttgttgactccccatatatatagtgcattcctagaaccttgaggacctcgtgtgaattgttatctctttyttaccgtkgtaatttcagtgccattagtgtcctttttcattcctagaagcttccaggagttgttgcctgttgttggtgacatctctcaaatttgggtttaattgtttgtattaattartcatttatgaatgtgaatggaagcacwgaaattttatattttcttaatttttttcttttttctaaggagatctgatctcaytcttgaatttgkgatccttgaagagcttatcagttatctgtaccaaaaaaaaagtctgtccatgcatttaataaattttattgttgtttatgtaagcgtaacaa

SEQ ID NO: 783 - DNA, 401 bp, Artificial Sequence
  Consensus Reference Sequence
tyttaccgtkgtaatttcagtgccattagtgtcctttttcattcctagaagcttccaggagttgttgcctgttgttggtgacatctctcaaatttgggtttaatwgtttgtattaattartcatttatgaatgtgaatggaagcacwgaaattttatattttcttaatttttttcttttttctaaggagatctgatctcattcttgaatttgkgatccttgaagagcttatcagttatctgtaccaaaaaaaaagtctgtccatgcatttaataaattttattgttgtttatgtaagcgtaacaagtgcagatggtcgatcrgcatccttaacatgttaacaaacacaaaatatcaagatgcacatattgaacatggacttcatcatcaatgtcagaattt

SEQ ID NO: 784 - DNA, 401 bp, Artificial Sequence
  Consensus Reference Sequence
attattaaaattaaactcaattaatatttcccaattgggtatgacaaacaaacttgtaccggrcggatatcactccacccctatctcgagtttgatgaagaatttccactttgacgakaaatggatacgggttcgagtaatacttgattttttagaaatagggataggaatgggtaagtacatatttgctcagtgtaaattatctctattttgtatgttgttcgktaatcaacactcactcaaataaaattatgcacacacataaaggatcgtgagaacacaacaaaaattataagattgtaactcaccctaaatagtatatcactttacgaattccagtattycacttagtgattacaaraaataataacactcayacaaaaatatttttctcccaacaa

SEQ ID NO: 785 - DNA, 401 bp, Artificial Sequence
  Consensus Reference Sequence
tatttcccaattgggtatgacaaacaaacttgtaccggrcggatatcactccacccctatctcgagtttgatgaagaatttccactttgacgakaaatggatacgggttcgagtaatacttgattttttagaaatagggataggaatgggtaagtacatatttgctcagtgtaaatyatctctattttgtatgttgttcgttaatcaacactcactcaaataaaattatgcacacacataaaggatcgtgagaacacaacaaaaattataagattgtaactcaccctaaatagtatatcactttacgaattccagtattycacttagtgattacaaraaataataacactcayacaaaaatatttttctcccaacaaagtaactttatttaaaaaatctct

SEQ ID NO: 786 - DNA, 401 bp, Artificial Sequence
  Consensus Reference Sequence
cgtatgtatagcagacaagttattcaatgcatcaaatagctaaagttaatatgatagatgatatataaatgtaagtaattaagatttgatgagtattagaagaaaaaataattgatgagattacttaagaatgtacatatamtcttgacaaaagatacagataatatgctataagagaaatagatgaattaattaatgtatattgtctaatcacatcattttaaaggaagaagaaagtgtttcatttgatgaaatatcatttagtcattgtctgacattgactgtttaggtcatctcactccamgcttcttcagcgtgattcaacttgattaagtcacaagtcaatcattgatgcaaataattttttttctccatgtctactaattaaaataaaatgtgat

SEQ ID NO: 787 - DNA, 401 bp, Artificial Sequence
  Consensus Reference Sequence
  misc_feature 163: n = A,T,C or G
ttgtctctagatgtacaataatggaatggctgattgaatagtagttgmcacttgacactcaaatctacttataaatcattaattaaaagtataacaacttttctgcgtgacctataattaaatcaatatctatttgggtaacccaattcaaatataatataancatttttgggagagttaatgaggtctgcagaactcatcatctgttattatacttttttaatgctgggtatttcttatgcccaattattatttataayagatatacttttgctgawaaaaaaaaaahmaatatctatttccattaaactccaattttcaaggttcaaatgttcagagatacaaatgcacaagtctccaagtccaccggasatggaatgaaggaataaatcttgactgac

SEQ ID NO: 788 - DNA, 401 bp, Artificial Sequence
  Consensus Reference Sequence
ttttaagttgttgttgttgctgctgctgctgcatggttattggcagcatcatggaggtgtacattttcatccaattcatcatttgcacttgcgcttgcaattgcttcatatattggatcacctcatctagcatcgaagctttatcagtctgcaaaayaaacaagggttatrttgtaaaattatatggcttaaataattaagtyttttttttgtargagatcatattatgcatatcctttgttaaaaataatcatattcgagttaattagattattattatgaaagrcaattttctctcyaatattaatattwtcgagtaatcatataatactagacaaaatttwctttgcaatataatgtaattcatatcaaaaacttaaactcgagaatgataattaaac

SEQ ID NO: 789 - DNA, 401 bp, Artificial Sequence
  Consensus Reference Sequence
tgttgctgctgctgctgcatggttattggcagcatcatggaggtgtacattttcatccaattcatcatttgcacttgcgcttgcaattgcttcatatattggatcacctcatctagcatcgaagctttatcagtctgcaaaayaaacaagggttatrttgtaaaattatatggcttaaataattaartyttttttttgtaggagatcatattatgcatatcctttgttaaaaataatcatattcgagttaattagattattattatgaaagrcaattttctctcyaatattaatattwtcgagtaatcatataatactagacaaaatttwctttgcaatataatgtaattcatatcaaaaacttaaactcgagaatgataattaaactacaacaatgtatc

SEQ ID NO: 790 - DNA, 401 bp, Artificial Sequence
  Consensus Reference Sequence
yaatattaatattwtcgagtaatcatataatactagacaaaatttwctttgcaatataatgtaattcatatcaaaaacttaaactcgagaatgataattaaactacaacaatgtatcaatcggatctaaaagtattatcttatcagtagtcagtagaggattctcaccaagatgtgtagacatagagtctaattgtctttgtgttagtaactcaattattaatcaaaagtgaaacctttttatttcgarcaaacttaaagattgaaactgaattttgtcatttaggcacatattcctttaagaagttcttcaaagagayataaaaggattccaattgatttctgaaatgcgtttgctttatgagaaggccaatcctatgcagacacaaaatgaaacatata

SEQ ID NO: 791 - DNA, 401 bp, Artificial Sequence
  Consensus Reference Sequence
atcggatctaaaagtattatcttatcagtagtcagtagaggattctcaccaagatgtgtagacatagagtctaattgtctttstgttagtaactcaattattaatcaaaagtgaaacctttttatttcgarcaaacttaaagattgaaactgaattttgtcatttaggcacatattcctttaagaagttcttcaaagagatataaaaggattccaattgatttctgaaatgcgtttgctttatgagaaggccaatcctatgcagacacaaaatgaaacatatactatawggagatgcgatatrtgatctgggsttcatggcattgtgtcctcatgggaccactgaaccgattaattggtgaacagggaaagaaattaaagagaggatcaatgttgcagctt

SEQ ID NO: 792 - DNA, 401 bp, Artificial Sequence
  Consensus Reference Sequence
aatcaaaagtgaaacctttttatttcgarcaaacttaaagattgaaactgaattttgtcatttaggcacatattcctttaagaagttcttcaaagagayataaaaggattccaattgatttctgaaatgcgtttgctttatgagaaggccaatcctatgcagacacaaaatgaaacatatactatawggagatgcgatatgtgatctgggsttcatggcattgtgtcctcatgggaccactgaaccgattaattggtgaacagggaaagaaattaaagagaggatcaatgttgcagctttatcatgttacgtatggccactttcttacataatagagaatttgaaaaaagattgggaacataattttataccaaaaacttggctaagttacaaccattctt

SEQ ID NO: 793 - DNA, 401 bp, Artificial Sequence
  Consensus Reference Sequence
gaaacctttttatttcgarcaaacttaaagattgaaactgaattttgtcatttaggcacatattcctttaagaagttcttcaaagagayataaaaggattccaattgatttctgaaatgcgtttgctttatgagaaggccaatcctatgcagacacaaaatgaaacatatactatawggagatgcgatatrtgatctggggttcatggcattgtgtcctcatgggaccactgaaccgattaattggtgaacagggaaagaaattaaagagaggatcaatgttgcagctttatcatgttacgtatggccactttcttacataatagagaatttgaaaaaagattgggaacataattttataccaaaaacttggctaagttacaaccattctttctttacctt

SEQ ID NO: 794 - DNA, 401 bp, Artificial Sequence
  Consensus Reference Sequence
aagttgaataaaataatttattttagtacatatggtwyggttataattttttatgtattatatggttatgaaytgtaagtagaaaaagttgatgttattgatttttaatttataggattatcaattttaatgttttataatattatatgcaataaaaaattacgtaggattttatgtgatagtatgtgtatggtgtggtttggggttatttgtttgtgatgttgaaattttttaatgtcttgttaagatggacgaagaycaatggatgtatgacagtataatgtctgaaaaagttgatatgaatgaacaaaataaagatgaagctggtgtgaatgaagaacatgttgattgttctgatgcttttaatacttcttaggtaataatgtaatttattgttatta

SEQ ID NO: 795 - DNA, 401 bp, Artificial Sequence
  Consensus Reference Sequence
gcaaaggatggatggtraagttaatgtatgggagtcacaatcatgaaatgacaaagtcattagttggacatcyatatgttggtcgatagactaagaatgaaaagacaagtattgttgatatgacaaagtcaatggtgaaaccaataaatattctrctaacgttgaagaagcacaatgttagtagttgtacaataatcaaataaatatacaatgcaagaagtgcataccgttcttccataagagacagtgatactgaaatgcaacatctaataaagcttcttaaaggagatcaatayattcattggcatagattaaaggwtgaagatgttktacgcgatatcttctggygtcatcctaatgcagtgaagttatgcartgcacgtaatttgatatttttgata

SEQ ID NO: 796 - DNA, 401 bp, Artificial Sequence
  Consensus Reference Sequence
agtggaaatttcargcgggttgcttggggactrgatgtaggcacagggcgtggccaaaccartataaaaactgagtttgtattctctcttcccttaaacttatgttatttattattctttatattttgctttaaagaagtttgtttttgaattgttcttagagtaattcataataagggttgcattgttaatcaaaaagagagttaaattttaattgggggatagcttgtgtatcttaattcaaccctctttcttaagataattgaggtyacttgtttaacatttgggatgccatgaacaacatgatcatgctacaacacaytgaaattaaggcatcttttgagacaagtatacatgtgattgrgcatgkttttaaagttaccttatacaagaggttactt

SEQ ID NO: 797 - DNA, 401 bp, Artificial Sequence
  Consensus Reference Sequence
ccttctctggtcagtgtatgaygacaacgggaccccatcggatatgtccagaaaaacatgaaataaggtcaaactttctaactacacggtggtcacygtaaggcatccaacaaacatcagcagccgtcagtcaatctagatgcttccgattcgtcratgctggtaatgccttcgtagaggctttcatagaggttcagcgataggcacrtggtgacctttcatcatagtcttcatccgtaaaagccttagcaatagatgaaaaatactcataaatycaacactamacaaatttcattagaacaaaaaaaatatcaaatgaacatattaaaaaaaaatttaaataacattcaatgacaattacccataatagtgtgatatatccaacaagttgtctgttgccr

SEQ ID NO: 798 - DNA, 401 bp, Artificial Sequence
  Consensus Reference Sequence
tataaaaaaacttttactattaaaaaaataaatataattaatttattaataattaaaaaatacatacaaattacataatccgtatgarttatacgaattacttaatcygtataacrcatgtaattcgtatgtartatatagaatcaaacttacytcaacgatagaaacaacacaacagcgwggagacgtcctcaaacccggcaatacaagwagccaacaacagtggcaacagcgaggaagacgaakcaacaacactagggaagaatatgacacgaacggaggaacagtaatgcaaggagaaagggtttttaaaatttaagtraaaggatattttactacttcacttaaatttggatgcaccagcaataatactgggtgcacctaacaacacccctscattg

SEQ ID NO: 799 - DNA, 401 bp, Artificial Sequence
  Consensus Reference Sequence
aagaaggtttccatgtttttcctttaccatgtcacagtatatatagtgtggtcttttgtttctggtttgcttgtgtaatttcgctgcatgcactttctccaaactaataactcttttttctttactaaaaacactgtgttgtgtcaccccwcttgaatcaatattcaaagcttcttctgctgctcctctgtgagtgcaattatcaccattcagccttggaaattctgaagtttgtaaagcagaaagtgagttagctgaagttgttgctttactttgttttgttctcttaatttttttaatttttttcaccctcacttggttactgtcttctcttctgtctagtctattcctttstttgtttttactgctctttctktttatatacaccgagkatttgattg

SEQ ID NO: 800 - DNA, 401 bp, Artificial Sequence
  Consensus Reference Sequence
tttgtgcatcacaagtgccctcaaaccgtcctgatatggcwgaggtaatcaacatattagagttgatccaatgtccttcagaggaattacaatgaattttaagttattataragattgaaacataacacatattgcaatatacacctggtgaagaacaatccagtttgatagctttaatgctatacaataktataaacyatgcaaagaatattcagtcaaatttctttcacaamttttgtttgttgtttcagttgtaagtttttccttttctttttacttttggtyatttcaagttgtactactggatttttcttcaccagtttggaacctaatacaatggygtttcaatcgtacttgtttttttyccccctacaaatcaggaattgcattttctaaacat

SEQ ID NO: 801 - DNA, 401 bp, Artificial Sequence
  Consensus Reference Sequence
atatggcwgaggtaatcaacatattagagttgatccaatgtccttcagaggaattacaatgaattttaagttattataragattgaaacataacacatattgcaatatacacctggtgaagaacaatccagtttgatagctttaatgctatacaataktataaacyaygcaaagaatattcagtcaaatttctttcacaacttttgtttgttgtttcagttgtaagtttttccttttctttttacttttggtyatttcaagttgtactactggatttttcttcaccagtttggaacctaatacaatggygtttcaatcgtacttgtttttttyccccctacaaatcaggaattgcattttctaaacatgaatattcgtggcatttttgtttggtttatgtt

SEQ ID NO: 802 - DNA, 401 bp, Artificial Sequence
  Consensus Reference Sequence
attacaatgaattttaagttattataragattgaaacataacacatattgcaatatacacctggtgaagaacaatccagtttgatagctttaatgctatacaataktataaacyaygcaaagaatattcagtcaaatttctttcacaamttttgtttgttgtttcagttgtaagtttttccttttctttttacttttggttatttcaagttgtactactggatttttcttcaccagtttggaacctaatacaatggygtttcaatcgtacttgtttttttyccccctacaaatcaggaattgcattttctaaacatgaatattcgtggcatttttgtttggtttatgttcttctgggacaaactgtgcttcatgttggtacgaagcccacacaacygattw

SEQ ID NO: 803 - DNA, 401 bp, Artificial Sequence
  Consensus Reference Sequence
ggryattccccagtcaatagacaaaaascaattctttcatgtggtaaaaattatcaaaataaatttkatttcttccaacaattttttttatatataattagaaatcgaatccttaataatatactttaaaaaatctactaactttattaratcttattgattgatrcatactcatctaacaaaatatgtacccgaaggattttttatwtatccaccaccatttaatttatatagcamattctccaaaaatttcactgattggacaatgttaaaaaattwgaatcacattcctagctcacactgaaaaggcttccttctctatcctaaaaaaaaaaaagtcaaaaacaagrtttttcatttttwaawatttttaaaaatatttttcgtaattaaaawtaaat

SEQ ID NO: 804 - DNA, 401 bp, Artificial Sequence
  Consensus Reference Sequence
ccccagtcaatagacaaaaascaattctttcatgtggtaaaaattatcaaaataaatttkatttcttccaacaattttttttatatataattagaaatcgaatccttaataatatactttaaaaaatctactaactttattaratcttattgattgatrcatactcatctaacaaaatatgtacccgaaggatyttttatttatccaccaccatttaatttatatagcamattctccaaaaatttcactgattggacaatgttaaaaaattwgaatcacattcctagctcacactgaaaaggcttccttctctatcctaaaaaaaaaaaagtcaaaaacaagrtttttcatttttwaawatttttaaaaatatttttcgtaattaaaawtaaattaarrgg

SEQ ID NO: 805 - DNA, 401 bp, Artificial Sequence
  Consensus Reference Sequence
arttytaaaatgcatcttatgttttggattacttaatacttttttatagataaatgttaattrttartttgttaattttgtgttaacatgagagattgaatctgtgatctttttctcattcttttcctttttaaccatccaatcaaccttatatctatagtattttaaaaytatactacatgacctctggatcatctatttcagattatgctattaaagtttcaaattgagtaatctagaacaaaaaatacattctarattactmaatatggaactatatatatgaaagtgayaagaggttgtwacactggtgtaagaaaggatagacaygaaggtagcacgaagrgagagaaaaattggatttggaggttgtggtggcgacacaaggaagaagaggcaat

SEQ ID NO: 806 - DNA, 401 bp, Artificial Sequence
  Consensus Reference Sequence
attttttcctgacaaagatattagtttttatttttagctattgtgatttttttatgatgtctctaatatttgtttttttttwgtcttttctactagcctctatwgtaaaaatgcttatgtaactrggacagtgcacatctaccaggaatgygaattacagattacactgggttttattattcarctygtagctayacargtttttttgtgtagtrttttgtcaccactagtgaagttagctggttctactcttgcaagttacaaataatgtgagtctttaacaacacactatagtacatarttcaaaggaaaatgacatgytccaaatcaattcttttgggttgaaaagggaatagttaaaatagcatttagcaccactatttcattttgtcatggtcact

SEQ ID NO: 807 - DNA, 401 bp, Artificial Sequence
  Consensus Reference Sequence
atgactgtaatgactgtcgaataatgaaagaagcatgcmttgtcttgaamatgatcaaatgcaaattctacatacactttgtattttttcttttgttttcatgttagagttttactttgtttgcttatatagttatatggatgarttaagtttttwgtscttaaattatgagrttttgaaaatcagtctycaaagaatttgyygttattaaaaataatatctayaattaagtgataaaatgtcatgaaataagatttgattaaatgtcacatgtatatcacatacatgttaagtaagttwtattatatttcgataaataattataatattatgttattaaaatgyaaaaggaaaaaagaagaatyattgttraattctaactctcaaagcacccatgagra

SEQ ID NO: 808 - DNA, 401 bp, Artificial Sequence
  Consensus Reference Sequence
tryygttattaaaaataatatctayaattaagtgataaaatgtcatgaaataagatttgattaaatgtcacatgtatatcacatacatgttaagtaagttwtattatatttcgataaataattataatattatgttattaaaatgyaaaaggaaaaaagaagaatyattgttraattctaactctcaaagcacccatgaggagatctgcaacgcrgagyarcaattcatcctcatcatttataatctatagtaatartgatattcgtggtaaacacttaatgcttaatatagattattaatgataaagaatatttataataamraaaaattatttaaggatcaaatatttttttaaaaatagtttaaggatyaaaaattcaaaactccayaatttgaggac

SEQ ID NO: 809 - DNA, 401 bp, Artificial Sequence
  Consensus Reference Sequence
taataamraaaaattatttaaggatcaaatatttttttaaaaatagtttaaggatyaaaaattcaaaactccayaatttgaggaccaaaaacttaattaaccttgatsattgaatttatcaagtttattaagtgtaattactaaggaaataatttgttttaaaataggcactygctatttacaccacaatttttgttaagtacayccyattcctcctttttttatattttaattattcattrtatcctttttccttaaagaratatactccttggagatcctttttrttttctaraaatrtctctcaaataatatatacttattytgaaaatgtktctcattattttaattgctcattatacaaaawgatatatccattggaaaccttttttttttccaaa

SEQ ID NO: 810 - DNA, 401 bp, Artificial Sequence
  Consensus Reference Sequence
atttctaatattagaaaattaacttttatcttatattttataccttatgttgtgagtyttattttcattatatytttaaaatttatycaaaatattattttcatcatatctttattattttttaaatccdaattttgtrttacatatttattatataataatgtatgtattacatttaatattatacgtttttttcacatcgcattatatttcaaggtatgtttcattttttttattattattattttaaattgagaaagagcgtataaaraktgttgttaacattcccaagtctaagaggaaatgtggtagagggagattttactgggattattcggttgacatgtgaaagatagggactccaaacggraattattttgtatatagtataaatacattta

SEQ ID NO: 811 - DNA, 401 bp, Artificial Sequence
  Consensus Reference Sequence
atmtatttagctcttacagttggaytcaatcaaattcagttcatatacaaaattarcgtgacccgttattttttattttgctgaataaaaaaattaaaaaaattcaattcaaaccgttaaatakaagtaaaatatatatctaaattaaattcaaccattacaraaaaaaaaagtatgtttgagtgttatatccaaagaaatcctgctacatgtttggttaggaagggraaaaaaaagaatrcagatatctatttatttttccttctatttagttaaaaagaatgtaaaaaatcactttttaaaaaccaagttatattttttcttaatatatttattataaagttytatgtttaaaattaatttattaaatatawtttgttayaaaatarttttaaattaat

SEQ ID NO: 812 - DNA, 401 bp, Artificial Sequence
  Consensus Reference Sequence
agtttaacaaccttgaatrattcaagtaaaataatcctactrragatcttatgtgcaagtgcaacgaaacayacacaaaagtacatattaaagatttaacaatatcataaatttaaataattttaaatatgataragatcayaaatatcattgatgagatacaatcttactcaatgtcattatggaggtcaatgttcctatcctgagtagttaacacaaatgcaaaccaaaaattcaataataattatttttatttttaaattctataaaatcatttttaagtaaatatataatagatatattaaaattaatatattagtcccggttcatcyttgtgtatgaaataaattggaatgggagggaaatagtcaaattatgtgcactcagaattctggaggaag

SEQ ID NO: 813 - DNA, 401 bp, Artificial Sequence
  Consensus Reference Sequence
  misc_feature 284: n = A,T,C or G
twatatgtagtaataaaaatattaaaatcaatttataaaatgtatttttattacaaaatagttttaggttacttactcaatatgctctttcttcaaatatttcacacaaattcatatcaaagacttaataatatcataaattaaaataattttaatcatgacagggatcttaattatcattcatgagaaataatcctacttaaaatttttacaaatgacayagttctttcgccgwgtagttaacacaattgtatatcaaagagtaaaaataatatttttttttnaaatttgaaaacccatttttactttataatcacttttacataatatataataactactaaaatttaattattaaatataatttttaatacaatacttttaaaatrcttactcaataa

SEQ ID NO: 814 - DNA, 401 bp, Artificial Sequence
  Consensus Reference Sequence
  misc_feature 398: n = A,T,C or G
cactgatttattttctgttcttatcatgattggttycacattattattatgtcatgcacttcatcatgrtgtgttgcactaatattaatratcgttctacaaatctttgttgtaccccttaaatttcattrgcttctgycttttttttctkatggaaattaattaattaacattgatttttgaagtgcttgttrattacrtgcaccatggaggaaagagtggggcttttgtttctgattttttcatgcaagagaggtaacaattgttagattggcctttttyttatctttttgcttttaaatttaattatcgtgctaagtkagatggatataahrtagttacaacctcacacyaaayttactgtaccataataaagtttayctggttcttgtagtaanaat

SEQ ID NO: 815 - DNA, 401 bp, Artificial Sequence
  Consensus Reference Sequence
  misc_feature 362, 369: n = A,T,C or G
tcttcaatttaccgaattgcaattgtatatttatyatgcttttatcaattcttayrtatctacatatctatcatatttttakaataatcataccactattaatttataggacagaggataagagataagctgaaaycatccaatmcttctgaagttcacttgrtacaccttttcatcyttyacatygtasccaacgaaaaccctcacaaatgaaaattcaactattgagaaartgtcaatttsacgtcaattaaatcaaaagttacatttagcactagttyawatttgaacttarattcatgrrtargtayagtttctccrggccaatcaayyatatctgaaaaacaaaaataartttcccncggtcantttcactctggcctcaataatcttaaagataa

SEQ ID NO: 816 - DNA, 401 bp, Artificial Sequence
  Consensus Reference Sequence
  misc_feature 293: n = A,T,C or G
gaacagtttggactacagatgctgttttttcactgcgggttgttagaagaattttacttctcctaataatcccacggttaaatggtttcttaagaagacgccaatcaacataatcctctgtccaaacatcatccaaracaattaagaattttttatctttcagyttgtccatcaattcaagatgaagtarattcagatcattmaatttacaagcctttccagtcaccgcctctattatagtttttgtgaccttgagaacatcaaattcttgagaaacacaaacccatgccttnaaatcaaartcaaatatctgtttcaaattctcatcrttgtacaccaattggrccaaagtagtttttccaaccccacccatgcccacaataggaaccacagacacttcw

SEQ ID NO: 817 - DNA, 401 bp, Artificial Sequence
  Consensus Reference Sequence
agatcattgagccagtgtttgacattggtgtttgtgatctgtttcttctcggcatcatcaagcacagctccaaccaytctgagagtgktctccaacttttgaagcaacttcttgctaagcttctttccacggatcaggtcaacaaagtcaggtgaagccagcctgtygaaaagcacatcaaggaaagcagagagaaaggccccacckaccagtgctgcagccatkatctcaagaacaaaagatgatcagagtagaaagwmaaaggcaagggaattggttgctaygaactgggttggttcttggtaaggttaactgatgtgatgagatttggcttaaktcaactstcttcaccttcactcgttctgctgtgcaagacaaaagtatggtcttttttatttgta

SEQ ID NO: 818 - DNA, 401 bp, Artificial Sequence
  Consensus Reference Sequence
cttaaktcaactstcttcaccttcactcgttctgctgtgcaagacaaaagtatggtcttttttatttgtattattatggtggtgggtgacttatcrcgttkkgagtctctttmctkttccccacatttaaaaagtgatgatatttctaccgttaatttaaaaaaaatggattatatttctaaaatgctwtaattaaagtttgtgatggccagctttytygctttccaaaycgtgtggagcagtggtgtgtgtttttttcttggtgatatgtgtggatggctgcaagggtactgtgcrtaattawgttcctgtgctttratgctgwgacaagttgtattgaagcagtttgcacatktgttttggatatttttatttwaaaaataagttaayagtaaaattga

SEQ ID NO: 819 - DNA, 401 bp, Artificial Sequence
  Consensus Reference Sequence
  misc_feature 325: n = A,T,C or G
agttatgtaaagatcctcaacttagaattttttttctaaagttaaaatttaaaatbaatttttcaatrtgaaagtaaatagtgaatatttayttaaattygtgttagtttatatttcaayctaatcattaaaattgtcatagagatatgrtattttataaaratytaayactgaatcatgattttataaatttaaaatrattrataatratttatgttttttaatcaagtgrtawaagatttaaatytttattaattcttatatatakaataaattttgttargaggaaaataaaaaaatgagattaaaaaattattaagacaanaaaaatgttgaamaaattaaaagagaaagaattaaagaaaggacacatgctaattgatccctaaaaayataatatt

SEQ ID NO: 820 - DNA, 401 bp, Artificial Sequence
  Consensus Reference Sequence
gggaacccaacttctctttgctcctattattttttaatttaaaaaaatwattaaattcattttttatatattttttaaaataaaaacccttgagcttccttctacttctatagtctctaccaagaktttgytrctttattgcttttaattatctccaaactttgaatggcgggagccgttgggagagaagagacaagcaggtcgcrattactaatataaagtgatattagagattcatataataattaattagttttaagaaatatttaatttcagttttttgcatttaatttaattaatttatatgtaaaattattcaaaatattatttataaactttaaatattataaaaatyaatttttatttaaaaattaaagtataataattgaatcattttatca

SEQ ID NO: 821 - DNA, 401 bp, Artificial Sequence
  Consensus Reference Sequence
cccaacttctctttgctcctattattttttaatttaaaaaaatwattaaattcattttttatatattttttaaaataaaaacccttgagcttccttctacttctatagtctctaccaagaktttgytrctttattgcttttaattatctccaaactttgaatggcgggagccgttgggagagaagagacaagcagstcgcgattactaatataaagtgatattagagattcatataataattaattagttttaagaaatatttaatttcagttttttgcatttaatttaattaatttatatgtaaaattattcaaaatattatttataaactttaaatattataaaaatyaatttttatttaaaaattaaagtataataattgaatcattttatcattcat

SEQ ID NO: 822 - DNA, 401 bp, Artificial Sequence
  Consensus Reference Sequence
tattagagattcatataataattaattagttttaagaaatatttaatttcagttttttgcatttaatttaattaatttatatgtaaaattattcaaaatattatttataaactttaaatattataaaaatyaatttttatttaaaaattaaagtataataattgaatcattttatcattcatattttaaaattaccataatattttaatttaatataatttatgtgtttaaatttttatayaaaaaattctcatataattttataaatacgcgcgtgaatttattattaaatatatgtttcgtgcataacaagagagttraataartaycgagtgtcattgttattctttcaaaaattagagttcaactcttgasatctttccaycacctcacttagtcgc

SEQ ID NO: 823 - DNA, 401 bp, Artificial Sequence
  Consensus Reference Sequence
atttaatttcagttttttgcatttaatttaattaatttatatgtaaaattattcaaaatattatttataaactttaaatattataaaaatyaatttttatttaaaaattaaagtataataattgaatcattttatcattcatattttaaaattaccataayattttaatttaatataatttatgtgtttaaatttttatataaaaaattctcatataattttataaatacgcgcgtgaatttattattaaatatatgtttcgtgcataacaagagagttraataartaycgagtgtcattgttattctttcaaaaattagagttcaactcttgasatctttccaycacctcacttagtcgcagcatctgacaatatttaatttataagtaatgttttcagt

SEQ ID NO: 824 - DNA, 401 bp, Artificial Sequence
  Consensus Reference Sequence
gtttacagttcgtgtgtttcatgccaatatataattttcgtaaataaattgcacgaatcctttgcatcactcatatatacaagtgctgcaacttgttatcacctacttgactagtcacatatrtttaattttaacaccaatttgaggaaaaataaattktaaraattmttttttgtcaaatctgcacgaggtgtgattatttcaaaacctatttggtatttttaatgaatattagtttttaaaaagttgttaataagtcaggtataccctttagaatctatagtttacggtttgtgtatggaaaatataatgctgtgttaggaaagaggattttgtaaaagtcgcmcgaagtttgatgtctgtaaatctctttttacatgcyttttaaatttttttaatcg

SEQ ID NO: 825 - DNA, 401 bp, Artificial Sequence
  Consensus Reference Sequence
ggaaaaataaattktaaraattmttttttgtcaaatctgcacgaggtgtgattatktcaaaacctatttggtatttttaatgaatattagtttttaaaaagttgttaataagtcaggtataccctttagaatctatagtttacggtttgtgtatggaaaatataatgctgtgttaggaaagaggattttgtaaaagtcgcccgaagtttgatgtctgtaaatctctttttacatgcyttttaaatttttttaatcgatattcattttawaaaatcataaccgtccattctatatttcgtgtaattcgtgtggatttacytttcataacagatagcatcattctgtttgtattttgtgcaaataattttcgtactaagtagcaacgttgatraataaaacga

SEQ ID NO: 826 - DNA, 401 bp, Artificial Sequence
  Consensus Reference Sequence
cgtccattctatatttcgtgtaattcgtgtggatttacytttcataacagatagcatcattctgtttgtattttgtgcaaataattttcgtactaagtagcaacgttgatraataaaacgaaaaagagattatgatgatgatgatgatgattggtacaaattgtattgcatgaatcacaaattaattccrycactaaactgcatattttcgccaggtatgattttgtcaaaacccatttgtaattattattattattattattattattattattaacgaaaaayatgtgttgtcacgcwttatatttatatttctattttgcaaacacatttttattatattaaatttaaaattatatattataacaacattttttatttatgctcttactaaayyttta

SEQ ID NO: 827 - DNA, 401 bp, Artificial Sequence
  Consensus Reference Sequence
  misc_feature 379: n = A,T,C or G
attcaaaccgaactaattggtttggttccgataagcaaaacaatatagctttaaatagggtttgtctaactaaayctaagtaaaaatttcactgaaaaattcaaacttgcttcttatgatwtttaatgaaattcaaataacattctagaaaatatgtagcggtaaacatggcaggagataggtaagtacaggaatatgttgggycgttcacagcaggaacttgagccactgatacaactattgaggaagagcaaagaggttgtttacaagtgttcaaaaatagggaaatacaattttgtggctaagaattcttaccgtggaaaactaaaattaaagatcttgcagactcaattgrgaggtttttcaatattgaaatgcnagctcttattgcacgcgatcaa

SEQ ID NO: 828 - DNA, 401 bp, Artificial Sequence
  Consensus Reference Sequence
  misc_feature 92, 317, 321, 322: n = A,T,C or G
ccgattcggtgatcgcgccattagctatagctgctgctgttacwgttgctatagtwattaaatttattaaatktcttctgttmtaatttttncwtgattaattagggatatttggatagtctggataaggttttagtttcaaactttattgtctttattgtrtatwagcmaccgatttgtcacgcctrttatrtttttgcttttttattgtactttcgcatttctattaagctaattaaagatgttatatatatagttaaaaaattctcttattttatgtatrtatatatatatatatatatatatatatatatatntatnnatatatatatatattrgtttcatatgtttttaaatgcatgtttatctttagaattttctttacttcttatastctacta

SEQ ID NO: 829 - DNA, 401 bp, Artificial Sequence
  Consensus Reference Sequence
  misc_feature 84, 88, 89, 323, 324, 325, 326, 327, 328, 329, 330, 331,332, 333, 334, 335, 336, 337, 338, 339, 340, 341, 342, 343,344, 345, 346, 347, 348, 349, 350, 351, 352, 353, 354, 355,356, 357, 358, 359, 360, 361, 362, 363, 364, 365, 366: n = A,T,C or G
  misc_feature 367, 368, 369, 370, 371, 372, 373, 374, 375, 376, 377, 378,379, 380, 381, 382, 383, 384, 385, 386, 387, 388, 389, 390,391, 392, 393, 394, 395, 396, 397, 398, 399, 400, 401: n = A,T,C or G
aattaaagatgttatatatatagttaaaaaattctcttattttatgtatrtatatatatatatatatatatatatatatatatntatnnatatatatatatattrgtttcatatgtttttaaatgcatgtttatctttagaattttctttacttcttatastctactatttatgataatatatagtaattcaattttattttgtatattgtatgtaggctaccgtagttttttttccaacaaaatgatttgtattaaatggtaccaaaatacctaagatcsaaaaacatatacaccagtgacagtagaaagaaasmaaattcnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 830 - DNA, 401 bp, Artificial Sequence
  Consensus Reference Sequence
gtaaaatgattttacaytattataaattmttgtttgaattactttaaaataattattttaaaagtcaacaaacttatcacatagtgagttgcaattaggtaatggtttaaatatatttttrgtctmtgataaatactcattttttrcatttgrtccctaataaatttttgctttgtgatrggtccctaatatttaaaaagttttgtycgaagttcctrccgttagtcgaaatccattatcttcatatgtgatcgwtaaccgatcacgtaagattttttatwtttttatagaaaaaagtaaaaaaacgacatcattaagtccccgaatcctccaaaccacccccaccagtccycaaccaactcctccactagctccacaccaccgctattrtgtctccaaaa

SEQ ID NO: 831 - DNA, 401 bp, Artificial Sequence
  Consensus Reference Sequence
agtaaaatacaaaaaaaaaaacaagatcatatctgcatttccagaagtatyttatggaatctagattaccyaggaagtkaaattaaaaacttgaaaraagaaacagagaaaaaagaaaatattttaagataagttgtaacccggaatcaaamtaaaagtttataaatarttcaagcacatatatatattttggtgtcttggtcttattgatgtattttgcagacattgatatacttttattaccctatagagctrgaacaagatcaactaattgaaggtttagtgacattgtcacaaagcaaagaaaatgcctgatttatgaatattcacyttgaatctacgtgagtcagaacaatttcgttcaccaaaatatgccattgcagttgaggtggtcggtcgta

SEQ ID NO: 832 - DNA, 401 bp, Artificial Sequence
  Consensus Reference Sequence
ctgagktagcagtttgtcagtwgtgaaaccctccttgtccaacaattccatatgaggaacactacctgacaacattgctgatttcaaaagccttgwattcttggatatctcttataaactcttttcctcatccttgccattgggaattggtaaattagggagcttgcagaatctctcgttggctgaaaataacttctcctgactctatttcagaratggcctccatcaartccctcaacttgacttgcatgggaatatgcttcaaggtgtacccaacagtagtatgttagaaattctgaggaactctatgcattctgcactctactttttcacgaaatgcctccatttcaaaccaaataaaatggtgatcaaatcttcaatwctctcattaaaccaaaaaa

SEQ ID NO: 833 - DNA, 401 bp, Artificial Sequence
  Consensus Reference Sequence
tgtcagtwgtgaaaccctccttgtccaacaattccatatgaggaacactacctgacaacattgctgatttcaaaagccttgwattcttggatatctcttataaactcttttcctcatccttgccattgggaattggtaaattagggagcttgcagaatctctcgttggctgaaaataacttctcctractctatttcagagatggcctccatcaartccctcaacttgacttgcatgggaatatgcttcaaggtgtacccaacagtagtatgttagaaattctgaggaactctatgcattctgcactctactttttcacgaaatgcctccatttcaaaccaaataaaatggtgatcaaatcttcaatwctctcattaaaccaaaaaatatatgaacccaac

SEQ ID NO: 834 - DNA, 401 bp, Artificial Sequence
  Consensus Reference Sequence
atrtcattatggasgtcaatgttcctaccmtgrgtagttaacacaaatgcaaascaaaaattcaataataattatttttatttttaaattctataaaatyattttaagtaaatatataatagatatattaaaattawtatattagtccccsttgatccttgtgtatgaaatawattggrttgggaggggratagtcaaattatgtgcactcagaattctygaggaagattagtcacttagtatttttattttaaaaaaaattaaattatttactaagaaatarcataaattaaattagttttattctctttrggataatgactaaaaataattcttcttatgggccaaccattataggaaaaaaaaaamctctttcgcgagtaattaaaacaattgcatat

SEQ ID NO: 835 - DNA, 401 bp, Artificial Sequence
  Consensus Reference Sequence
agaattttttatctttcagcttgtccatcaattcaagatgaagtagattcagatcattcaatttacaagsctttccmgtcaccgcctctattatagtttttgtgaccttgagaacatcaaattcttgagaaacacaaacccatgccttraaatcaaaatcaaatatctgtttcaaattctcatcrttgtacaccaattgggccaaagtagtttttccaaccccacccatgcccacaataggaaccacagacacatcrctaccgtcactgttatcctccracaacaacttgattatggcctcchtatctttctccctaccatatatatgagatccatcttccagagatgttgatggagctttccatgacaagttctccactgcactctctttcaaatcaaga

SEQ ID NO: 836 - DNA, 401 bp, Artificial Sequence
  Consensus Reference Sequence
ctcaagaacaaaagatgaycagagtagaaagacaaaggcaagggaattggttgctatgaactgggttggttcttggtaaggttaactgatgtgatgagatttggcttaaktcaactstcttcaccttcactcgttctgctgtgcaagacaaaagtatggtcttttttatttgtattattatggtggtgggtgrcttatcrtgttgggagtctctttcctgttcyccacatgtttctttcttgatatttctattttgaatttwgctyctctaaactaaagactcaagagatttaaagagtgacratatttctacggttaatttaaaaaratggattatatttctaaaatgctttaattaaagttagtgccagctttctcgytttccaaaycgtgtgkagcag

SEQ ID NO: 837 - DNA, 401 bp, Artificial Sequence
  Consensus Reference Sequence
hacatgtgttttggatatttttatttaaaaattaagttaatartaaaattgaaaatgawtttttttgttaaatccaaaagttatgtaaagatgctcaayttagaatttctttctaaagttaaaatttaaaatcaatttttcaatgtgaaagtaaatagtcaaatatttacttaarttcgtgttagtttatattttaacctgattttttataatcaaayacagatcattaaagaaagttrtcatakagatatgttattgtataaagatctaatactgaatcatgattttataaaaagttaaaataattgatartamtttatgttttttaatmaagtgrtaaaagatttaaatctttattaattcttacatatagaataaattttgttassaggaaaataaaa

SEQ ID NO: 838 - DNA, 401 bp, Artificial Sequence
  Consensus Reference Sequence
  misc_feature 107: n = A,T,C or G
aastaaaatatattyagtgagatcatctcaaacaacaatagtaaaatgagagataaagaaaatttaagtccarcaaatgaaaatattttactatatrtaaaaaatantttttctcctatmatatttaataaatataattttattttaaatcaacaggtatawatttttatcaatagttaaaatagatttaagtgaacttyttagaaaaacttttttatttgtttrttwaagtgttgaaratatttatcctctaacttattttttmtcatyacaattawtttttyctttttacyaccaaacaaaaccttacaggatttttttactccactacacttgctctctcctcatttyttycaaaatacacctgcctcaaaattgtttcctaaacaacactccttttt

SEQ ID NO: 839 - DNA, 401 bp, Artificial Sequence
  Consensus Reference Sequence
tattttcagataaaaaataattaaaatttttaatattattattttgttttttaaataatgagaatatttttgtttaawtatttattwatagtttgaaaataattaattaataatcttaaaataaatttaaaaaacaaagtgattraaaaaatagatkgattaaaaacmcaataaatatatgattatcacatcttaattatgttatattaaraaattaaaatactcaaataacataaaatactaaaaattaaasagacaaacatcataaatgraamatrtaataaagcaaaaatarcagaatgractaacaataataattgaaacatgaaaataatgaaagcataaacaactaacacatgaatcattcycattatcaacctcatttgattattaatccttgg

SEQ ID NO: 840 - DNA, 401 bp, Artificial Sequence
  Consensus Reference Sequence
taaaaaataattaaaatttttaatattattattttgttttttaaataatgagaatatttttgtttaawtatttattwatagtttgaaaataattaattaataatcttaaaataaatttaaaaaacaaagtgattraaaaaatagatkgattaaaaacmcaataaatatatgattatcacatcttaattatrttatattaagaaattaaaatactcaaataacataaaatactaaaaattaaasagacaaacatcataaatgraamatrtaataaagcaaaaatarcagaatgractaacaataataattgaaacatgaaaataatgaaagcataaacaactaacacatgaatcattcycattatcaacctcatttgattattaatccttggrawggaggca

SEQ ID NO: 841 - DNA, 401 bp, Artificial Sequence
  Consensus Reference Sequence
taataatgataataataataataataataataataataakaagaataaggygratacaagctagatcttacataatggtaattaggaaaaacaaaaccagaraccccctctrataggraagagtgatagcatagcatacaaagggatgcagaaaaaatagatgtgaatcaagacatagcaactayaggrgwgtctatagctaagaagggtgcaaatcaagcagaaaaggaggtgcaascagyagttaataccaaaagaaagatmtcgaagcytgcttaccttaaggaytacgtgtgatcctaaggaatgatgytgaatgatctgtgctrgaagcaagggagacaagaataacgatttctgatttcctctagcacaaaaggacaaaatctgttatgtagaaa

SEQ ID NO: 842 - DNA, 401 bp, Artificial Sequence
  Consensus Reference Sequence
agaataaggygratacaagctagatcttacataatggtaattaggaaaaacaaaaccagaraccccctctrataggraagagtgatagcatagcatacaaagggatgcagaaaaaatagatgtgaatcaagacatagcaactayaggrgwgtctatagcwaagaagggtgcaaatcaagcagaaaaggaggtgcaascagtagttaataccaaaagaaagatmtcgaagcytgcttaccttaaggaytacgtgtgatcctaaggaatgatgytgaatgatctgtgctrgaagcaagggagacaagaataacgatttctgatttcctctagcacaaaaggacaaaatctgttatgtagaaatcartataaatacaawwgcatgtaataagcagcacrrtatg

SEQ ID NO: 843 - DNA, 401 bp, Artificial Sequence
  Consensus Reference Sequence
atcctaaggaatgatgytgaatgatctgtgctrgaagcaagggagacaagaataacgatttctgatttcctctagcacaaaaggacaaaatctgttatgtagaaatcartataaatacaawwgcatgtaataagcagcacrrtatgaatgaaattagcaaattactcccatctctgctcttcttcttcctctggaggttytggtgcctcaaagccarctcttaatttcctgcatttatgtttagttygtaacaattggtgctctcgttygtcctcatggcctchygcaacctygaygaggyccttgttcrtcttgacaataccatgcactctatgaccctcaayatggacaagcttctcaaccrccttrctcttgtgccttcctccaycacgcccaacccc

SEQ ID NO: 844 - DNA, 401 bp, Artificial Sequence
  Consensus Reference Sequence
ayatggacaagcttctcaaccrccttrctcttgtgccttcctccaycacgcccaaccccacaccagtccctygccackccacctctgttcytgcacaaatycgrtatgccycatcacygtatgaggatcytgcyratgccttgttcaaactcactyagacgggttcagtgctaacatacctgaaggagttcgaagacttggctaatagaattatcggcttkycggcccccttcctrttgccttgcttcatctcgrgtttgacrttgaagatctgccgcacagtccargtccmccagcctatgactgtggaccaggccgccrgccttgygaagatccaggagcagaagctatcrgaccttcgtctgcctccaycgcggccgcgaccccaccrttggtagctc

SEQ ID NO: 845 - DNA, 401 bp, Artificial Sequence
  Consensus Reference Sequence
ccagtccctygccackccacctctgttcytgcacaaatycgrtatgccycatcacygtatgaggatcytgcyratgccttgttcaaactcactyagacgggttcagtgctaacatacctgaaggagttcgaagacttgrctaatagaattatcggcttkycggcccccttcctrttgccttgcttcatctcgrgtttgacgttgaagatctgccgcacagtccargtccmccagcctatgactgtggaccaggccgccrgccttgygaagatccaggagcagaagctatcrgaccttcgtctgcctccaycgcggccgcgaccccaccrttggtagctccaccrccagyccctttggytccccctcgtatgacgcctttgccccctttgttgcctkccccg

SEQ ID NO: 846 - DNA, 401 bp, Artificial Sequence
  Consensus Reference Sequence
ccctttggytccccctcgtatgacgcctttgccccctttgttgcctkccccgccataggctccgaccgtcaggcgtchyaccccrraggagttagyctcgcrycatgagcackrgctrtgcttcacatkcgatgagaagttccatagaggccattgatgtgcctctagggttcatctcttaatcgcaraggatgaggaacttgtagactaggggtgggtaaatgggcccaagtccatggactggcccgcggcgcacgcggtccgcgcgagttacggtccaattttttaaaacagttcatggttatgtyatattttttggcccrccccgcttaatccacggactatgcgggtttggccgcggggtccacgggttgcycgyaacccgcattwggtttgatttg

SEQ ID NO: 847 - DNA, 401 bp, Artificial Sequence
  Consensus Reference Sequence
actggcccgcggcgcacgcggtccgcgcgagttacggtccaattttttaaaacagttcatggttatgtyatattttttggcccrccccgcttaatccacggactatgcgggtttggccgcggggtccacgggttgcycgyaacccgcattwggtttgatttgtgtgaccctgacccaattatattaggtttrattttctctttttcwctttaaacttttcttttaaaataacagataaagaaatatattatataagataaagatttaaagrtaaaaataaaagatttaaattaaaasatggtaaagataaaaaagataagataagaaaaataaaagataacagaaataaaakattaagataaaaaaakataagtgataacatgytaaaaatcttcttttct

SEQ ID NO: 848 - DNA, 401 bp, Artificial Sequence
  Consensus Reference Sequence
tgccaccacgcaaagtacatctcttctctctytagaatttgtttttatcctatttttgttgggaytgattcatttttgttgtactcttaaatgtggagatggagaakgytcaagctacttcaaatatgraatcatttgttgtcagagatgtttaaatttcatattttagatttattdyttggattttctttygttaagaccttatttattttattgatgtaattgactaattattgagattttatttacakctatattgaacttaatttgattgtattgtatttttattaaaattgaaattattttaaaaytaggcccgtggatcggcccgtttgactcgtgggrtccatgggcrgrggcggaccaatttatttggtccrtgtaagaagcrgggcgaactg

SEQ ID NO: 849 - DNA, 401 bp, Artificial Sequence
  Consensus Reference Sequence
caagctacttcaaatatgraatcatttgttgtcagagatgtttaaatttcatattttagatttattdyttggattttctttygttaagacmttatttattttattgatgtaattgactaattattgagattttatttacakctatattgaacttaatttgattgtattgtatttttattaaaattgaaattattttaaaattaggcccgtggatcggcccgtttgactcgtgggrtccatgggcrgrggcggaccaatttatttggtccrtgtaagaagcrgggcgaactggcccgctccgcttcyaatgcgggcgggccttacacggggyggggtggcccgcctacccacccctaycgcatacccattgggtcctaatatagagmaacctracccgaakc

SEQ ID NO: 850 - DNA, 401 bp, Artificial Sequence
  Consensus Reference Sequence
attttaaaaytaggcccgtggatcggcccgtttgactcgtgggrtccatgggcrgrggcggaccaatttatttggtccrtgtaagaagcrgggcgaactggcccgctccgcttcyaatgcgggcgggccttacacggggyggggtggcccgcctacccacccctaycgcatacccattgggtcctaatatagagmaacctgacccgaakctagccacacccgtatcygaaggacctgacccaaarcccacacytgactcrgaccyaaaccccacacccgacccggaacygrcccaaattagttcraactccttatcgggtgatttagcaccgagaattttgcaccycgtcggccttctctccgrcaatcgtgtggtcctccttgttgatgrgggaagtaac

SEQ ID NO: 851 - DNA, 401 bp, Artificial Sequence
  Consensus Reference Sequence
ggcccgcctacccacccctaycgcatacccattgggtcctaatatagagmaacctracccgaakctagccacacccgtatcygaaggacctgacccaaarcccacacytgactcrgaccyaaaccccacacccgacccggaacygrcccaaattagttcraactccttatcgggtgatttagcaccgagaattttgcacctcgtcggccttctctccgrcaatcgtgtggtcctccttgttgatgrgggaagtaaccacaacttcctccagcctcaactagytatctctctgggcttaccttgycggaccgctccaacaccattacgcgtgatgttctttcatcacgggcgcttmgtggaatttctgggtgagaacgccaccactccgggtcttcttcccc

SEQ ID NO: 852 - DNA, 401 bp, Artificial Sequence
  Consensus Reference Sequence
tccgrcaatcgtgtggtcctccttgttgatgrgggaagtaaccacaacttcctccagcctcaactagytatctctctgggcttaccttgycggaccgctccaacaccattacgcgtgatgttctttcatcacgggcgcttmgtggaatttctgggtgagaacgccaccactccgggtcttcttccccaacaccagttctgtcacctctrtcgrcacaacgagggtktttcgcacttccatattgctaggtttcckraagctcctcctgactcactacccattgacacacctagtgcagttcgtcrgaataaaccttgggatcccggtattgtttttggaygccatagtttgaaaaaccaacaccatgaggacatgtttttgatggggcagggagtgataag

SEQ ID NO: 853 - DNA, 401 bp, Artificial Sequence
  Consensus Reference Sequence
rcacaacgagggtktttcgcacttccatattgctaggtttcckraagctcctcctgactcactacccattgacacacctagtgcagttcgtcrgaataaaccttgggatcccggtattgtttttggaygccatagtttgaaaaaccaacaccatgaggacatgtttttgatggggcagggagtgataaggaagcgtgatagcatagyagacaaagggatgtattcaaaagaaatmgatrygaatcaagacatagcaactataggggtgtctacagcaaagaagggtgtaaatyaagyagaaaaggaggtgcaagcagcagtcaataccaaaagaaagatctcaaagcctgcttaccttaaggactacgtgtgatcctaagsaaygatrttgaatgatctkt

SEQ ID NO: 854 - DNA, 401 bp, Artificial Sequence
  Consensus Reference Sequence
  misc_feature 151: n = A,T,C or G
ctctgtggaggccctggtcctcvaaaamcagcttctatcwtcttccctatcaacaagtatatarcatatataattatgyatgayaattttaaraaaataaacaacactaatataaaatatatagaatggtaaaatamaaaaaaaaaaaaanaagatcatatctgcatttccagaggtatcttatggaatctagattaccctagaacagaaattgaaaacttgaaaaaagaaacagagaaaaaakaaaatatttaagatatgttgtaacccrgaatcaaaataaaagtttataaataattcaagcacatatatatayaccaaataataatascttagtaaaagcaaawaaataataataccttagcaaawtttcctctgaaaasagagagtggaaccttcca

SEQ ID NO: 855 - DNA, 401 bp, Artificial Sequence
  Consensus Reference Sequence
aaataatttttatttttattttaaataaaaaattattatgaaatataagtttttatcaatwgttgagataaatttawgtgaacttggtatcaatsattattgtgtagttaaagtccyagatccaackactcataaaartttaaatttyctttgcatataatataaatagacataactctaaaaatgaatttttattttatttttttgttaaagtcttaaaaatatttatcctctaatttattttttctcctcacaattatttktatcttttgtaaaagataaattataatgtttttttaaacaattttaatmtactattattatatttttatttaatatttaagaatatttctataatttaaactcatgcactaartataaattatattttttcatgayat

SEQ ID NO: 856 - DNA, 401 bp, Artificial Sequence
  Consensus Reference Sequence
gcactaartataaattatattttttcatgayattaatgyaaagtatttatcaattttryatactgataactcatctttgwagagaaatttagttagtaatctttaaygaagtyactatttttaattatttttaatatgtaagacttaaatmtaaaatyttgagttaaggagatgtattttatttttgtcttaactcttcggttcatcatrkraaatgatcctgaaatcagagttaagtaaaatcttatcaataattatttttgttaarycgaattcarataatatccaaacgattcaaytttattttaaataractaataacttatactcagtcacttartcatttggttgcatcagatttaatttcactctaggcaataacatgttggtcacaakaatat

SEQ ID NO: 857 - DNA, 401 bp, Artificial Sequence
  Consensus Reference Sequence
yactatttttaattatttttaatatgtaagacttaaatmtaaaatyttgagttaaggagatgtattttatttttgtcttaactcttcgrttcatcatrkraaatgatcctgaaatcagagttaagtaaaatcttatcaataattatttttgttaarycgaattcarataatatccaaacgattcaaytttattttaaatagactaataacttatactcagtcacttartcatttggttgcatcagatttaatttcactctaggcaataacatgttggtcacaakaatatatattacatattaactttraaaataaaatataataaamtttctaactcaactttttaawtttcttarttttcattctaatartatggtcactcatcaaagcatggcttgggt

SEQ ID NO: 858 - DNA, 401 bp, Artificial Sequence
  Consensus Reference Sequence
cctgaaatcagagttaagtaaaatcttatcaataattatttttgttaarycgaattcarataatatccaaacgattcaaytttattttaaataractaataacttatactcagtcacttartcatttggttgcatcagatttaatttcactctaggcaataacatgttggtcacaakaatatatattacatattaactttgaaaataaaatataataaamtttctaactcaactttttaawtttcttarttttcattctaatartatggtcactcatcaaagcatggcttgggtatatactatatarmgaagatcctccgtcatcttgaggatatwtcatgatcataagtggaataagaatgcacatattgcaaagatagaaatttawkaaagacagtgca

SEQ ID NO: 859 - DNA, 401 bp, Artificial Sequence
  Consensus Reference Sequence
atatattaaaagcggytttttcamcaaataaakatttgctaarmaaatcatcacsraaataatattgaaaaaaatacaaataagttcgtttggstttrctttttyatacatgckgttagaataaaggtgtaatcactactagaaatgagytatttaatgatgcacatctatcagggattgttttagaatgtgtctgygtgttaattttgtaattagaggaaaaaacaacgataattttctgtgataattgttgttttaattcctcttagtagtgaccttgagaatayttataarcyggaagtggtagggaaaaatacttgttgtaatcaagtttgattagtgaaatcctttactggttagtaaaggagaactaaggagaactaracgtaactcargtgayc

SEQ ID NO: 860 - DNA, 401 bp, Artificial Sequence
  Consensus Reference Sequence
cttagacwatccttagtattagtttctctttatctgtcttgaatttgtgattagttgcyatatttctttatcttatcatgacttgttttcttaattcggattatgattagcatataagggttagtactatrggttttatgaatatatcaaatcaaatatacaaatgtttaaatacatctaagttaatatcaacccagtgtttcattctcttttatctcttttcctccctcawtatctwaaagtatrtaatttcaacaataacaagakattttttggtgaacacaacaaaatgctaaaagttgtaatcatcatattcatgatctgaaaataacaaagatgaactcattttyagatgtttgatgccaaaagaaaaaggatgagttacccagctaatattaact

SEQ ID NO: 861 - DNA, 401 bp, Artificial Sequence
  Consensus Reference Sequence
aattatttttgttttaaaaaatttacttattttaacaaataaattccatttgtttcttaaaaaaatatttatttttaaattattttaaaaaattwaaacaaactcaccttttatttgaattgtttgtgcttttaaaaawawtttttttttcttgttttaagaaataaattctatctatttttttttaaaatatttatatccgcgatacgaatatstaaataaagagactaaatattgttgtcttggagtggtatgttttcaatttctctctatatatagttataattattttattatattaataaatgtgacgtatggatgaaacactctgattactatactwtttctgcacacatttttattttgctttaatcttagaaaktacacattgataaaagaaa

SEQ ID NO: 862 - DNA, 401 bp, Artificial Sequence
  Consensus Reference Sequence
taaaaaatttacttattttaacaaataaattccatttgtttcttaaaaaaatatttatttttaaattattttaaaaaattwaaacaaactcaccttttatttgaattgtttgtgcttttaaaaawawtttttttttcttgttttaagaaataaattctatctatttttttttaaaatatttatatcmgcgatacgaatatgtaaataaagagactaaatattgttgtcttggagtggtatgttttcaatttctctctatatatagttataattattttattatattaataaatgtgacgtatggatgaaacactctgattactatactwtttctgcacacatttttattttgctttaatcttagaaaktacacattgataaaagaaaatcttcaactacta

SEQ ID NO: 863 - DNA, 401 bp, Artificial Sequence
  Consensus Reference Sequence
  misc_feature 167: n = A,T,C or G
actctgaagggaagcgtgtggcagtcaagtattactcagatgactggccaacaaacaatgcaaagttagcttktgasaagtttgtatttaccaagactgttaagacaaatgctcgtagaaggtaagcagtagagtttgacaactatgaatctatgaagtcactatanttaatattaggtgctaggggtggctgtttcaatttaaccatcatkttttatgtaacagatttttgcttaatgattacgctaggggtggccggagtacgtgatgagaaakgtatcctatcattaaggattgttacarmagtcctcttatatgcgtgtgtgggtaaatgggtattgaaaatctcacacttgatataattttttcatgtrccaatacagagacaaagaagytycaaa

SEQ ID NO: 864 - DNA, 401 bp, Artificial Sequence
  Consensus Reference Sequence
agtaagaaatcatttttggacataaacgtcagtaaaaawtttatggatcaaattgtcagtatttttttgttgaaggaatttgycagtaatttcacawagttgcagtaagctttgcacaattcttggggtgtccaracattaaccaaatctttttcaacttcttcccagacatagaattcaccatcgacatactccagtgctccrtttgcattttgtatgaatttagcattgtggtgtaaaataagaytgatttcatcagacatcctatayagagaaatataacaaaaattaattgtatattcacaaaaagagaacataaaaagtttcataatagagaacaraaggcaagtttcataatagagaagagaagagaagaartttgagaataaagaagagaacac

SEQ ID NO: 865 - DNA, 401 bp, Artificial Sequence
  Consensus Reference Sequence
atgaagaacttctcttgtagaagtttctgaaagtgtgggagatgaagaaaaatyaaraacctrgcttttgggaatgaagagtcaattttggattgtgtaatccttttgggaatgaagaaaattagcagatgccaaaaaaccctatatatttattttcacaatracgggaaccatagaatgcaaggcttgtattattcactctcctatatatttatttaccaaacwttggtggaaattttaaggagtgacaggttcatattagcttttaaccatcaatggaaaactggaawaaagaaaaggctggcactaacaaccagttatttgtcaataggaaaggaagcttggcccaattgaaggatrttgtggaaaattagtgtctctttgatttcagaagctttacc

SEQ ID NO: 866 - DNA, 401 bp, Artificial Sequence
  Consensus Reference Sequence
taccgatcttcctatyrgaaaagcgagaaaaaaagtttcttaccttgttttggktggcagctttggtgaaaacatggtcgagtaagtcatcrgcttcatagacagcatctttgagatcattgagccagtgtttgacattggtgtttgyggtctgtttcttctcggcatcatcaagcacagctccaaccactctgagagtggtctccaacttttgaagcaacttcttgctaagcttctttccaaggatcaagtsaacaaactcaggtgaagccagcctgtcgaaaagcacatcaaggaaagcagagagaaaggcaccacctaccactgctgctgccattacctcaagaataaaagatgatcagagtaraaagacaaaggcaaggaattggttgctatgaact

SEQ ID NO: 867 - DNA, 401 bp, Artificial Sequence
  Consensus Reference Sequence
cttcactttcastcgttcttgataaggtttttttatttattatttgtattattatggtggtgggtgacttatgactagtttcatttctgtttccaaaccgtgtggakcagtggtgtatgtttttttctttcatttctgaaattgcttgyaggtttcacaaaacactgatcccttttctttgtgatatgtatggatggctgtaagggtactytgcgtatttaagttcctgttaatggtctgtaagacaagttgtattaaggcagattgtacatgtgtttgtatgaacggtacaaaagttgatttyacaaatctaatttatatttggatatttttattccaaaaataagttagtagtaaaattgaaaatawttwttttttgtgtaatccaaaagttatctaaa

SEQ ID NO: 868 - DNA, 401 bp, Artificial Sequence
  Consensus Reference Sequence
ttaacataattttagaaaatcaaacataaatmtaatatgcacgattaaagttgtcatagagatgtgttgytctrgaaargtttaataacaaaccatgatctcataaataattgacattagtagtagtaatttrtgtttcttaatcaagtggtacaagattcaaatcatgattaatctttacatawagaataaataaatatgaaattaaaaaatattaaaccaaaaaaaaagaagtattgaacaaataaaaagaaagaattgaacaaaagrcacatgctaatkgatccctaagaacataatattaatgaattaaagagttcaatatgtccttatytgtacatarmaaakaaaagaagtatgtagaaagaaaagtgtgtgattttttactaaataaaatcaat

SEQ ID NO: 869 - DNA, 401 bp, Artificial Sequence
  Consensus Reference Sequence
ataatttctataaamtatatttttattttaaatcaacarctattttgaagtataagtttttatccatagttgaaatggatttaagtgaactttatattaatgactattatgccgttaaaaaaagggtaaccagtcattttcgtcatgcaatatgtagaacactgacaaattcgttacagaaagatgtaaattctaattttggtcctcgaaagtgaaaaaagtgtgayaaattcattcatctattaacttccattcgttacttttaatgaaagagcaaacatgacacattcagggaygaatttgtcaaygctcaacacatccagggrcaaaaatgattattcayccaaaatataatttaatcttcatctttctcatttttcaatcgttgcaagcayagttgt

SEQ ID NO: 870 - DNA, 401 bp, Artificial Sequence
  Consensus Reference Sequence
tatgccgttaaaaaaagggtaaccagtcattttcgtcatgcaatatgtagaacactgacaaattcgttacagaaagatgtaaattctaattttrgtcctcgaaagtgaaaaaagtgtgayaaattcattcatctattaacttccattcgttacttttaatgaaagagcaaacatgacacattcagggaygaatttgtcaatgctcaacacatccagggrcaaaaatgattattcayccaaaatataatttaatcttcatctttctcatttttcaatcgttgcaagcayagttgtgaaatsyagtttggctcagctattcggaccaatccaactgagacccggtggtytagccgaaccarttccactattggatcgrtcatacaattgacactggaggaccc

SEQ ID NO: 871 - DNA, 401 bp, Artificial Sequence
  Consensus Reference Sequence
gtaaccagtcattttcgtcatgcaatatgtagaacactgacaaattcgttacagaaagatgtaaattctaattttrgtcctcgaaagtgaaaaaagtgtgayaaattcattcatctattaacttccattcgttacttttaatgaaagagcaaacatgacacattcagggaygaatttgtcaaygctcaacacatccaggggcaaaaatgattattcayccaaaatataatttaatcttcatctttctcatttttcaatcgttgcaagcayagttgtgaaatsyagtttggctcagctattcggaccaatccaactgagacccggtggtytagccgaaccarttccactattggatcgrtcatacaattgacactggaggacccagccaaactaggacaatt

SEQ ID NO: 872 - DNA, 401 bp, Artificial Sequence
  Consensus Reference Sequence
caactgagacccggtggtytagccgaaccarttccactattggatcgrtcatacaattgacactggaggacccagccaaactaggacaattagccaccakatcccggttggaccagtcygacctgactgattttacaaaaaaawaawaaatcacctctacrgtgttgttttgatgtcttattattatcaattgttatattggattatgaagtatggatggattttttttgctcaaataatgttagttatatayttatatatagataaatatataattttaaatttttataatatatcaggtcaaacaagtycaatgactggtccaacaccactrrcccacccaccaaatattttgatttggtcaatgatcgaactgagtttcacaactatagttgcaagta

SEQ ID NO: 873 - DNA, 401 bp, Artificial Sequence
  Consensus Reference Sequence
tacaaaaaaawaawaaatcacctctacrgtgttgttttgatgtcttattattatcaattgttatattrgattatgaagtatggatggattttttttgctcaaataatgttagttatatayttatatatagataaatatataattttaaatttttataatatatcaggtcaaacaagtycaatgactggtccaacaccactgrcccacccaccaaatattttgatttggtcaatgatcgaactgagtttcacaactatagttgcaagtataacattacaataaacacttaaaaaatagraaaacaaaacttagttaaaacaaacataatgataaacataatattgatttaaaagcttattattatgtttattctaarttatgttwgattttctatttttttt

SEQ ID NO: 874 - DNA, 401 bp, Artificial Sequence
  Consensus Reference Sequence
gtaactgacatgtatcttatcattcgtgcagytatcatckgtatatwgagcacaacacgggaaggygttgactggctggtactaygaatattcatccgccacgtgrcaccatatgattggatgaccttgctactagtcatrggaagagcccgccttgtggttaggtgttgaasgatgtttggcatagcatcattttcattttccctrattctcaccaatctcacacccaaaagattttgtcactttataacaagagagttgttactaasatttaataamggaccaaaaagtttgaatgataaactatacagtatttttaacaattttaatatactattattatatttttatttaayatttaaaaatattwctataatttaaacccatgcattaartataaa

SEQ ID NO: 875 - DNA, 401 bp, Artificial Sequence
  Consensus Reference Sequence
tgtggttaggtgttgaasgatgtttggcatagcatcattttcattktccctrattctcaccaatctcacacccaaaagattttgtcactttataacaagagagttgttactaasatttaataamggaccaaaaagtttgaatgataaactatacagtatttttaacaattttaatatactattattatatttttatttaatatttaaaaatattwctataatttaaacccatgcattaartataaagtaattttatattattattcactcatatatcatcattaatataattttwaagataattattatagttattatagatgataaaataatattgaatgaagttttaaatttgatttacacttttattatatgacytattttttctatttattaacaag

SEQ ID NO: 876 - DNA, 401 bp, Artificial Sequence
  Consensus Reference Sequence
acaattttaatattctaatattatatttttatttaatatttttaagttttaagttttcttagtatttaagaatatttattaacaagaccttttatggctatttttttyagtaatgagaattttgcattttatttcactcactataataataatgatgaygattgagttatgttcaagtgaagcgagtgtatgcatgagtgtaaattaacttatttagttgaycagacttttcttataattcacaaaggttrttacaaaaattcaatgtatmtaatttaagtataytaatgcattaaaatctatttatatatgtatatataagatatatttrttaaattcttaattgaaattgtaagaaagatgaagaaaaaaatcaaccarbaggcaaaaatcaaatcaaa

SEQ ID NO: 877 - DNA, 401 bp, Artificial Sequence
  Consensus Reference Sequence
tatatttttatttaatatttttaagttttaagttttcttagtatttaagaatatttattaacaagaccttttatggctatttttttyagtaatgagaattttgcattttatttcactcactataataataatgatgaygattgagttatgttcaagtgaagcgagtgtatgcatgagtgyaaattaacttatttagttgatcagacttttcttataattcacaaaggttrttacaaaaattcaatgtatmtaatttaagtataytaatgcattaaaatctatttatatatgtatatataagatatatttrttaaattcttaattgaaattgtaagaaagatgaagaaaaaaatcaaccarbaggcaaaaatcaaatcaaattcagattctatcattcatga

SEQ ID NO: 878 - DNA, 401 bp, Artificial Sequence
  Consensus Reference Sequence
tcatattattgagacctcacktgattttatttgtgtgaaagattttgatagawttttacttattcaatactactataaaatggatagtacaaaatttcgaaacaatatagartatacygatattcctttttatgactttacatttcttaatttctaatgytatacaaagtttttatactacaaaaartagatcatcaaatgtatttttattgaaattaagaattttttttattatgaaaatctccctaattaaatgtaacaaattaaatattttactctattatttttataaatactagtcaatgcttaaagaacatttaataaaaaaawtattattttgaatacataaagataaagaatataccatactataatatttggtctttaaaatgattaaacac

SEQ ID NO: 879 - DNA, 401 bp, Artificial Sequence
  Consensus Reference Sequence
aattttcmtcaatatttttctgagttattattatttttatcttcattcttatttgaaaattttgaaatctggattcatttttgccttcaaggtttttaaacttttcgattttattattgtgggttttaaagtgattttttctttctaaattgtctctttktctctttgtttgtttcatgagaaacatcygtcatcatggtgtaggggatttaaatttkatgcttctgagttatttgtagtctattagcgtgtttgatttcacatcatcgacgtgatcattmtctgggaatgtgatttcatgaagctactagttatakcttctacatatctcagacatgattttttatttctcaaactgatttcyaacacgctatatatttcatgtgaaagaaaagacacat

SEQ ID NO: 880 - DNA, 401 bp, Artificial Sequence
  Consensus Reference Sequence
tgacaataacttagtgcatgtgacccaagcatgaaaattggtagatagactgccaaagttaggtaacsattgtaayggaaagtggaaccacatgcatctgaaaaaaggtgccaactcagttatatttttacttgcctatttgaaacyttactgaattttcgttttcttctcgagtgtcattaaactctcccaactttagacgattaatttgggcagatgagtgtgaatgacttgatttgtctatgtaattcaaaacagaatgcaggtctcacttgtttgcatgttccttttttatgaatctcaagttcattattgatgtattttgttgtattagtgtgctttctgccatctgctgattgattgtttgattaaattttatttcttctgmgtaatgtgttgcc

SEQ ID NO: 881 - DNA, 401 bp, Artificial Sequence
  Consensus Reference Sequence
tatcttttgyactaccaaacaaaaccttacaagagtacttgcttagtaggggtggkaataggytaagccggyctacaggggyctatgacctgrcctacataaagtctagcctatttaattaaaaggttagactaagacttttttaaaagcctattagattaaacakatcagacttaggcttattaaaaaaccttataagcttgatagrccggcctatatatatatatattattattttttgggtaccaatatataatattattttttggatayaattaatyttttttttgaaactatcagactttgattacactccataacttttattcytataatcaagaactttaattacaatttaggtrtgagtacggtgtccttttatattyctcattattttgatt

SEQ ID NO: 882 - DNA, 401 bp, Artificial Sequence
  Consensus Reference Sequence
ttttgggtaccaatatataatattattttttggatayaattaatyttttttttgaaactatcagactttgattacactccataacttttattcytataatcaagaactttaattacaatttaggtrtgagtacggtgtccttttatattyctcattattttgattgactttcctttttctttaactttcctattatgttcttactccataaaatattaaatatttattgtgaagaaggcttttaaaaaggctatcaggccasaccaggcttttaaaaaggtcaggcygagctaaaataaaagyttttgataggctataggtyagactyagacctcaaagattcatcgtagactaggctcaggccttttaaagycttgcctgacctatttccacccctattg

SEQ ID NO: 883 - DNA, 401 bp, Artificial Sequence
  Consensus Reference Sequence
tttattcytataatcaagaactttaattacaatttaggtrtgagtacggtgtccttttatattyctcattattttgattgactttcctttttctttaactttcctattatgttcytactccataaaatattaaatatttattgtgaagaaggcttttaaaaaggctatcaggccasaccaggcttttaaaaaggtcaggctgagctaaaataaaagyttttgataggctataggtyagactyagacctcaaagattcatcgtagactaggctcaggccttttaaagycttgcctgacctatttccacccctattgcttagtagaatccarctaagtatcatctcttctcctaaatatttgttakagtcttgttaataaaacaaatctttttttaatttttt

SEQ ID NO: 884 - DNA, 401 bp, Artificial Sequence
  Consensus Reference Sequence
tagaatccarctaagtatcatctcttctcctaaatatttgttakagtcttgttaataaaacaaatctttttttaattttttaatcaatactcttaaaacaaagatcaaacacactttctaaaagtattccattttatttattttatgaataagtagtattaaagtgtatttcactaaaaraaataaaaaaatgaaatacagtacattttttaataagatgaagtaaaagaagtgaaatatatatatatatatatatatatatatatatatatatataattttcataaatgtagtaataaaataaatgaaaaaaaaggtaaatagtcattttctttgaagygattgtatgcatgagtgtaaattagcttatttagttgaccagactttccttataattcaca

SEQ ID NO: 885 - DNA, 401 bp, Artificial Sequence
  Consensus Reference Sequence
aaagtcaraagtcatttgaaatgtaacakaacatttctttacvaatctaactagattttaaacttgtgcaktgtaccaataatgattgacacaartagtaatgacttgtatttyttaactaaatggtctagaktttgaatattggttaacccatacgcatagarttaaagaaagaayacatgytaatttattcctaaaaatataatattaatgaattaaagatttcaatgtccttacatatatgtcaaagatgtatgcgraaagaaaagtgrgtgatttttactaaataaaaycaataaaataaataaataatagatactaatatattatattaarttttgacaggtagatatycccataattttatatttatawtaaaaaaaaataggcttccadgtats

SEQ ID NO: 886 - DNA, 401 bp, Artificial Sequence
  Consensus Reference Sequence
tacgcatagarttaaagaaagaayacatgytaatttattcctaaaaayataatattaatgaattaaagatttcaatgtccttacatatatgtcaaagatgtatgcgraaagaaaagtgrgtgatttttactaaataaaaycaataaaataaataaataatagatactaatatattatattaarttttgacaggtagatattcccataattttatatttatawtaaaaaaaaataggcttccadgtatsaaaaatagractcagagagaaggggagtggcggatacaagccagatsttgagaatggtaattaggaaaaaacaaacccagacccmctccctttcytaargaagarcttattctcagcctctacgtacactctccttacaakctatccattcca

SEQ ID NO: 887 - DNA, 401 bp, Artificial Sequence
  Consensus Reference Sequence
acttasctcaaggattgcaagcaggtgcaccatatctcgaagcaatggcrgacctacagccatctgaggrygtgcacttgyaymccctcattttttaaaattcaccaaatttgtaaataaaatcttatatttttatagtttatttcatctawatttatataattgaacycattrattttattttttataatttgtaccaattracttagggtggatccgccactgtactggaagaatgatgytggtcgtgtaggggtagacaaacttaaccatttcctgatattctvtagcacaaaaagacaaatttgaytattgagaaatcagtataaataatactatgtaataacaacatyaatcaatggaatatacaattrttccttcccttattcttttctcactgg

SEQ ID NO: 888 - DNA, 401 bp, Artificial Sequence
  Consensus Reference Sequence
  misc_feature 342, 343: n = A,T,C or G
rattttattttttataatttgtaccaaytracttagggtggatccgccactgtactggaagaatgatgytggtcgtgtaggggtagacaaacttaaccatttcctgatattctvtagcacaaaaagacaaatttgaytattgagaaatcagtataaataatactatgtaataacaacatyaatcaatggaatatacaattgttccttcccttattcttttctcactggaggccctgrtcctcgaaaaccaacttttatcttyttccctawcaacaagtatatagcatatataattatgtatgataattttaagaaaagaatggtaaaatacaaaaaaaaaannaaaaaaaaaadatcatagctgcacttcvagaagtatcttatggaatctagattaccra

SEQ ID NO: 889 - DNA, 401 bp, Artificial Sequence
  Consensus Reference Sequence
  misc_feature 58, 59: n = A,T,C or G
catatataattatgtatgataattttaagaaaagaatggtaaaatacaaaaaaaaaannaaaaaaaaaadatcatagctgcacttcvagaagtatcttatggaatctagattaccraggargagaaattaaaaacttgaaagaagaattaaaatgatattaaaatcctcattattctattaaaaayaacaataaaataaagaaattctaatcattcttagttaaatttgactatcaattaaacycaattttcatagttatcaagtagtagaagtttttgttgsgaaagygttaagagtgdtagtgacattaaatatcgttgcaaaacttttcrcaacagatgatattacagtggactgcagcaacaattttctygctwgmaaaagtaagggattaayraat

SEQ ID NO: 890 - DNA, 401 bp, Artificial Sequence
  Consensus Reference Sequence
  misc_feature 15, 16: n = A,T,C or G
atacaaaaaaaaaannaaaaaaaaaadatcatagctgcacttcvagaagtatcttatggaatctagattaccraggargagaaattaaaaacttgaaagaagaattaaaatgatattaaaatcctcattattctattaaaaayaacaataaaataaaraaattctaatcattcttagttaaatttgactatcaattaaactcaattttcatagttatcaagtagtagaagtttttgttgsgaaagygttaagagtgdtagtgacattaaatatcgttgcaaaacttttcrcaacagatgatattacagtggactgcagcaacaattttctygctwgmaaaagtaagggattaayraattgtttatggtacracagttagtcatcatgaagggayaactatc

SEQ ID NO: 891 - DNA, 401 bp, Artificial Sequence
  Consensus Reference Sequence
  misc_feature 84, 121, 335: n = A,T,C or G
gttttaaawtgtagtcagcaacctaattgcagtcataacgctaatgtattttgactctgtaatcacatcacaattataattatnatcacatcarttgtatttttccataattatccacaantcacaatgtaagatttttaggttcgttgcatgcaacgcaatcakaattgcaatttaaaatcatgtctaaagccatgcaacattgatgcggcatcactaaccagcccccaccatcgtgcacataaacatcggttgcatttgkgatgatcccactcgaagagcagctaccaccgaatcaarttaacttcacatttcattcaaaattgtctcttcangaaacaagctccaggtgccatakatcattaagtaaaacaataattaaaattaggractctggcttt

SEQ ID NO: 892 - DNA, 401 bp, Artificial Sequence
  Consensus Reference Sequence
tgttaataaatttcccttccacacagttgatgcatctaaccctgaagaaaatrcaattctagtatggaagcaacaaatacaagtttgtttgtctttgtcctgctattctgatcctatctctatccagatgtatatatgtttgtatghgcatatatatatgcatccatgtatcactatcagaaaaatggctttttaggatgtgggttttacgacggttgtaaaaaatcgatgttgtaagtacatattgacaattttgtaaataattttaaaatttcaaagacgtctttgaaaatgaattacaacatcgrttcttgtagaactgatgtagaatgagcgcttcaggaatgctagcggactctttctcactctttatatttttatctttttttttatttgtctcc

SEQ ID NO: 893 - DNA, 401 bp, Artificial Sequence
  Consensus Reference Sequence
atattgacaattttgtaaataattttaaaatttcaaagacgtctttgaaaatgaattacaacatcgrttcttgtagaactgatgtagaatgagcgcttcaggaatgctagcggactctttctcactctttatatttttatctttttttttatttgtctccctatgcatgaccccaagccagtggcaagcctcccagaggcggtgtcctcgtaggtgtcrtggatgcaaacaacgttggggtgctcagagaggtggtgcatacgtcatcgtagtcctccttgcagagcagcttccgcttcgtgattgacttgcagstgaaggggcgtcccgtggcgttgtgcgtgcagargaaggttgtgccgaatttkcccatgccgagcttttagcttagggtgtagacc

SEQ ID NO: 894 - DNA, 401 bp, Artificial Sequence
  Consensus Reference Sequence
tgaccccaagccagtggcaagcctcccagaggcrgtgtcctcgtaggtgtcrtggatgcaaacaacgttggggtgctcagagaggtggtgcatacgtcatcgtagtcctccttgcagagcagcttccgcttcgtgattgacttgcagstgaaggggcgtcccgtggcgttgtgcgtgcagargaaggttgtgccgaattttcccatgccgagcttttagcttagggtgtagacctcgcggagattctcggttyggtatgggagtacccaggtgggctttggtggtaaggccgcagtggtgccggtggtggagtttgacattgtgttcgagagagagacagagtcagtgtgtgttaattgggagaagaaaaagaaataaaggaagacccagacctggtayaa

SEQ ID NO: 895 - DNA, 401 bp, Artificial Sequence
  Consensus Reference Sequence
tggatgcaaacaacgttggggtgctcagagaggtggtgcatacgtcatcgtagtcctccttgcagagcagcttccgcttcgtgattgacttgcagstgaaggggcgtcccgtggcgttgtgcgtgcagargaaggttgtgccgaatttkcccatgccgagcttttagcttagggtgtagacctcgcggagattctcggtttggtatgggagtacccaggtgggctttggtggtaaggccgcagtggtgccggtggtggagtttgacattgtgttcgagagagagacagagtcagtgtgtgttaattgggagaagaaaaagaaataaaggaagacccagacctggtayaagtgtttaatttaatttatgaatgtgagacttgctttcatgagaaggattatt

SEQ ID NO: 896 - DNA, 401 bp, Artificial Sequence
  Consensus Reference Sequence
ttkcccatgccgagcttttagcttagggtgtagacctcgcggagattctcggttyggtatgggagtacccaggtgggctttggtggtaaggccgcagtggtgccggtggtggagtttgacattgtgttcgagagagagacagagtcagtgtgtgttaattgggagaagaaaaagaaataaaggaagacccagacctggtataagtgtttaatttaatttatgaatgtgagacttgctttcatgagaaggattatttgaattacagatatcatgcaagaggtgtctctatctctgcttggtgaagaagtatttggagaagtcttcatytattgatagggttgaatggtccacgtactctgcagaatgaggccagaaaacccctgctcgttgtgtatccaggt

SEQ ID NO: 897 - DNA, 401 bp, Artificial Sequence
  Consensus Reference Sequence
ttcgagagagagacagagtcagtgtgtgttaattgggagaagaaaaagaaataaaggaagacccagacctggtayaagtgtttaatttaatttatgaatgtgagacttgctttcatgagaaggattatttgaattacagatatcatgcaagaggtgtctctatctctgcttggtgaagaagtatttggagaagtcttcatttattgatagggttgaatggtccacgtactctgcagaatgaggccagaaaacccctgctcgttgtgtatccaggtttgcactctgtgttagcttygaaatttaattctaatgcctttygaaataatgctgatgatgctaacaacgaaaataattgcagctgctaagcttattaaagttcctggtttttttgtaagaattat

SEQ ID NO: 898 - DNA, 401 bp, Artificial Sequence
  Consensus Reference Sequence
gtcwgcaactgtaaagccataaaacacttagttacttcttgaagttgaatgtataactgtcaataagtttagtttctaaccttacaacgttktcatttacatttctcatctcttttccattttctccttcttccctatttatcttctgtcaaagacacccttattcttaaaattgttacctttttataaattattgaatgttgatgacttcaatgtgtattttctcttttaaatttataggttgtatatttaaaatttaagcaccctgtctatatatggtttgatacttaggttcmcwgctgattataaaaaaaaatcattatttttaaaatttgtcaggtgcattacaaaacagactgctgattataaaacagatttttattctccgtttttatatagga

SEQ ID NO: 899 - DNA, 401 bp, Artificial Sequence
  Consensus Reference Sequence
tacatttctcatctcttttccattttctccttcttccctatttatcttctgtcaaagacacccttattcttaaaattgttacctttttataaattattgaatgwtgatgacttcaatgtgtattttctcttttaaatttataggttgtatatttaaaatttaagcaccctgtctatatatggtttgatacttaggttcmctgctgattataaaaaaaaatcattatttttaaaatttgtcaggtgcattacaaaacagactgctgattataaaacagatttttattctccgtttttatataggataaactgaaataaactttacctgacaaatgctacttttgtatatgctatgagttctgtttgcaggaatgrcgcataatgagctatgagccttgtatg

SEQ ID NO: 900 - DNA, 401 bp, Artificial Sequence
  Consensus Reference Sequence
tatgaattgctattttttacataattttcaatcctttaacagaccatatgcacagcagtttcattccttgcaattgtacctttgggagaattattctttttccatatgatcctgatacraaaggtatattcatgaacgacttttcctcctattgacatgtatattctaagctgtctttttcttttacagggtatcacaacttacgactatgtttgggagaattatctttccttggaaggttgtttctgctctggtattgaaaattttcccttgtcaggcaagttgaccttgttaaactaaatgagctataggcagatgagctcttacatgaagtttaaatgatgtgaacattagatagaaaatttcacaatgtgaagaaggatctgcctgttgttatttaa

SEQ ID NO: 901 - DNA, 401 bp, Artificial Sequence
  Consensus Reference Sequence
cttcatttaacctttgtcccatgatgttttttagatcaacataaaccaattatatttgtattacctaatactataatttttaacaaawtaaataaayctttgataggtgattgctactcttatgagtaactgctttttctgaaacgccaatgtgattctaattccctggtatcatatctaaaaaattctctttataatttttttttacatcaagttaatataatcatataggaaaaataatgatatttgcttgatgctgaaaaggcattattatacatggatggtgtagcttatatattagtrcagtagtagtactttcaaataaaaaattaaaaaaaaaaaaaaygaaatctctagtagtgcctaggcatatatttattatacactagctaggtgcagag

SEQ ID NO: 902 - DNA, 401 bp, Artificial Sequence
  Consensus Reference Sequence
aaatgacgatggttccttgttttgtttattaaaacatgtattatataattaggaggcctgatttttgctaccaaaattttaggtgcctttggagggttttagcgctcttcaaggaatttcaggtgcctagaggtttyagatacataaggcatatgagagttctaatcacttgccttatgctcatacttggtaccctttttttactttttagtttattatatatcatcaatgaacattttggtgtgcgtttgatttatgggtttcatcacttgatggatcatcattatcatgtgtcttcaagtaagtaaaacagagtcttttttatgcagtttcaatcaattagatttgccagagtatccatctaaacaacattgggaagggaggttactacttgtcattca

SEQ ID NO: 903 - DNA, 401 bp, Artificial Sequence
  Consensus Reference Sequence
gtatggtcatttgatacatatacagagtgttggtcacccatggaagcaaaggtagaaagttgatcttggagattttccatattaggaatccagatattagggcatatgctactraattgccattctttcttatatgtaattataaaacctaattcaattataaagtaagtctcatacacattaggttcaattatatttgctttgttattgccattcaggaacaaaaaggaaaaaaaaataagcatcctacatcggttattaggaaaaccgatgtagcatgwtttaccatgagtagcattctatgacgtttcgcggccaggactgrtgtagaatttcggacattctacatcggttattaggacaaccgatgtagaatgttttaycatgggtaccattctacg

SEQ ID NO: 904 - DNA, 401 bp, Artificial Sequence; identical to SEQ ID NO: 348
  Consensus Reference Sequence

SEQ ID NO: 905 - DNA, 401 bp, Artificial Sequence
  Consensus Reference Sequence
aacgacatcgttaagtccccgaatcccccaaaccwctcccaccagtcctcgaccaactccttcaccagctccacaccactactattgtttctcyaaaaccccccaaacctcccttgaaaccccatggcagcaatacaacaataacactaacccattttcttttttttcttctcttgwaccgtggcttcccatagcgacaataaatctccttctctcaaaaatcactcatggatcccccttccccaaagaaaaccctcttctttgttttcatcatttcmttctcttcacctacgacacacwagtgggtttgagggccaagtgtgagagaragactgggagagaagtgaggtttgagagttgaaggaagttaytggtgacagctggcacgagtaatggcatga

SEQ ID NO: 906 - DNA, 401 bp, Artificial Sequence
  Consensus Reference Sequence
tcggtaratttttcttgcgtgtatgaatttttcttgcrttwttcatgcaaatttattttattatttttattattttttttgttgcaaaatttgctatgattttggtaaaaatatgactatttgaaggaaagagtggggtttttgtttctgattttgtcatgcaagagaggtaacaattgttagattggcctttttcttatttttttgcttttaaatttaattatcgtgctaagggagatggatataacgtagttacaacctcacaccaaacttactgtaccataataaagattacctggttcttrtagtaataatataaatagtgatgaaccacatacmttctaaaaccaaatachcatacctgtttcatatacctagtaacttagagatagaatgcaagr

SEQ ID NO: 907 - DNA, 401 bp, Artificial Sequence
  Consensus Reference Sequence
atttattatgcttttatcaattcttacrtatctacatatctatcatatttttagaataatcataycactattaatttatagkacagrggataaragataagctgaaatcatctaatccttctgaagttcacttggtacaccttttcatccttcacattgtacccgacgaaaacctcacaaataaaaattcagctattgaggaagtgtcaatttcacgtcaattaaatcaaaagttacattyagcactagttcaaatttgaacttagattcatgggtargtacagtttctccgrgccaatcaaccatatctgaaaaacaraaataartttcccaysgtcattttcactctggcctcaataathttaaggadaaattaagttagaatataacaahactgatgt

SEQ ID NO: 908 - DNA, 401 bp, Artificial Sequence
  Consensus Reference Sequence
gggcagttgaatatttcgagayrttctaactttgggagaagactactcatctcttcaggcaaygacttcaactctgatatggtcaaattaataaagttgggcgcaggcaatccttctctccagaatgatacaaagttggggcatcgatgaatgtgcaaagaacacagactctcaaatgactctgcccctgaaaccgaaagttattccatattttcacagtctgtgattgtgakatctckgagatttggaaaggtaaccratggaagagatgtgagtgaatcacaactgctttctattgwcagtgtttccagtaactcatgtttgtgttgcdtcgggaattccagttttttaagatcyttgatactcagactcttcagtgattcwggtaaacgaccaccmgg

SEQ ID NO: 909 - DNA, 401 bp, Artificial Sequence
  Consensus Reference Sequence
tctcgaaaccaaatcatcaaaatactcatgaccaacctcttctaaagtcctaccatttcttggtttcttcaaaaratcttcrgccatccacaacaagattaattcatttttttcaaaytcrtaatcttgwggatacaabgaacaataaacaaagcaycgttttaaatgtggagggagataatgataactaagtctcagtgttggaataactttacattcactttcagaaagttcccaaatgtcactattcagaatattattccaacccccaatatcatgctttcttctcaacatgcctccgagsgactgtgctgctaaaggcaatccattgcactttttaacgatctcctttccaattttttctagtgttgttgtgttctcgttagattcckaggaaagac

SEQ ID NO: 910 - DNA, 401 bp, Artificial Sequence
  Consensus Reference Sequence
gaattttttatctttcagyttgtccatcaattcaagatgaagtagattcagatcattcaakttasaaggctttccvgtcaccgcctctrttatagtttttgtgaccttgagaacatcaaattcttgagaaacacaaacccatgccttaaaatcaaatatctcttccaaattctcatcattgtacaccaattgggccaaagtagtttttccaaccccacccatgcccacaataggaatcacagacacttctctaccatcactattatcctcygacaacaacttgatkatggcctccttatctttctccctaccatatgagatccatcttccagagatgttgatggagctttccatgacacgttctccactgcactctctttcaaatcaagrctctccttgag

SEQ ID NO: 911 - DNA, 401 bp, Artificial Sequence
  Consensus Reference Sequence
gtactgtgcgtaattaagttcmtgtgctttaatgctgtgagacaagttgtattgaaryagtttgcacatgtgttttggatatttttatttaaaaaataagttaatagtaaaattgaaaatgaattttttttgttaaatccaaaasttatgtaaagatcctcracttagaatttttttctaaagttaaaatttaaaatcaatttttcaatgtgaaagtaaatagtcaaatatttacwtaaattgatgttagtttatatttcaacctkatcattaaaattgtcatagagatatgttattgtataragatctaatactraatcatgattttataaacttaaaataattgatagtgatttatgttttttaattaagwggtaaamgatttaawtttttattaattc

SEQ ID NO: 912 - DNA, 401 bp, Artificial Sequence
  Consensus Reference Sequence
aagaaaatttaagtccaryaaatgaaaatattttactatatgtaaaaaatattttttctcctatcatatttaataaatataatttytataaaatataattttattttaaatcaacaggtataaatttttatcaatagttaaaayagatttaagtgaacttcctagaaaaacttttttatttgtttgtttaagtgttgaagttatttatcctctaacttattttttctcatcacaattatttttttctttttasyaccaaacaaaaccttacaggattyttttactccactacacttgctctctcctcatttttttcaaaatacacctgcctcaaaattgtttcmtaaacaacacttctttttagcttgcagagagaaatcggggttagggaacccaacttc

SEQ ID NO: 913 - DNA, 401 bp, Artificial Sequence
  Consensus Reference Sequence
  misc_feature 384: n = A,T,C or G
acwactaacacatgaatcattcycattatcaacctcatttgattattaatccttgggaaggagacatgttacaacctaycatagttttttyacctaacaactatggtattcatwctagaaaaaaaaatgtgaaaattttcrataataaagacataacagaaaaaattatctcaatatatcttcatcttcagtttttcatagataaatattattgttcatgtattttatttatgatgtaatgtattctagtacaaataaattgttgaatatatatatataattagtttttatacattttaaagaaaatactataaacaaaaaattcatttattaatttaacttgttaaataaaaatttaatttttttaaaaagaaaaattaattncttttattttttaaata

SEQ ID NO: 914 - DNA, 401 bp, Artificial Sequence
  Consensus Reference Sequence
  misc_feature 73: n = A,T,C or G
taaacaaaaaattcatttattaatttaacttgttaaataaaaatttaatttttttaaaaagaaaaattaattncttttattttttaaatattatttttacattaaaaataaattaattttttaatattactgttttactaaatatatttttaatataaaaataatatttaaaaaaaataaaggaattaatttttcttttagaaaataacaaaaagttaaatattattatggtggtgtgtgacttatcacgttggcctggatgctaatatagtaaagaatattttgaaaaagttgtaataataataataataataataataataataataataataataataataataataaggcgratacaagttagatcttacataatggtaattaggaaaaacaaaacy

SEQ ID NO: 915 - DNA, 401 bp, Artificial Sequence
  Consensus Reference Sequence
aaaacaaaacyagaraccccctytgataggaaagagtgatagcatagcagacaaagrgatgtattcaaaagaaatagatgtgaatcatgacatagcaactacgggagtgtctatagcaaagaagggtgcaaatcaagcagaaaaggaagtgcaagcagcagtcaataccaaaaaaaagatctcaaagccttaaggactacgtgtgatcctaaggaatgatgctgaatgatctgtgctrgaagcaagggagacaagaataacgatttctgatttcctctagcacaaaaggacaaaatctgttatgtagaaatmagtataaatacaatagcatgtaataagcagcacaatatgaatgaaattagcaaattactcccctctgctcttcttcttcstctgtaggt

SEQ ID NO: 916 - DNA, 401 bp, Artificial Sequence
  Consensus Reference Sequence
tatagcaaagaagggtgcaaatcaagcagaaaaggaagtgcaagcagcagtcaataccaaaaaaaagatctcaaagccttaaggactacstgtgatcctaaggaatgatgctgaatgatctgtgctrgaagcaagggagacaagaataacgatttctgatttcctctagcacaaaaggacaaaatctgttatgtagaaatcagtataaatacaatagcatgtaataagcagcacaatatgaatgaaattagcaaattactcccctctgctcttcttcttcstctgtaggttctggtgcctcaaagccagctcttaatttcctacatttatgttcagttcgtaacaattggtgctctcgtttgtcctcatgrcctcccgcaacctcgatgaggccsttrttc

SEQ ID NO: 917 - DNA, 401 bp, Artificial Sequence
  Consensus Reference Sequence
aaggactacstgtgatcctaaggaatgatgctgaatgatctgtgctrgaagcaagggagacaagaataacgatttctgatttcctctagcacaaaaggacaaaatctgttatgtagaaatmagtataaatacaatagcatgtaataagcagcacaatatgaatgaaattagcaaattactcccctctgctcttcttcttcgtctgtaggttctggtgcctcaaagccagctcttaatttcctacatttatgttcagttcgtaacaattggtgctctcgtttgtcctcatgrcctcccgcaacctcgatgaggccsttrttcgtcttgacaataccatscactctatgaccctcaacatggacaagcttctcaaccrccttrctcttgtgccttcctccacc

SEQ ID NO: 918 - DNA, 401 bp, Artificial Sequence
  Consensus Reference Sequence
acaaaaggacaaaatctgttatgtagaaatmagtataaatacaatagcatgtaataagcagcacaatatgaatgaaattagcaaattactcccctctgctcttcttcttcstctgtaggttctggtgcctcaaagccagctcttaatttcctacatttatgttcagttcgtaacaattggtgctctcgtttgtcctcatggcctcccgcaacctcgatgaggccsttrttcgtcttgacaataccatscactctatgaccctcaacatggacaagcttctcaaccrccttrctcttgtgccttcctccaccacrcccaaccccacaccagtccctcaccactccacctttgttcctgtacaaatccggtatgccccatcaccgtatgargaccctrttggt

SEQ ID NO: 919 - DNA, 401 bp, Artificial Sequence
  Consensus Reference Sequence
ccatscactctatgaccctcaacatggacaagcttctcaaccrccttrctcttgtgccttcctccaccacrcccaaccccacaccagtccctcaccactccacctttgttcctgtacaaatccggtatgccccatcaccgtatgargaccctrttggtgtcctgttcaaactcactcagacgggttcagtgctaacatacttgaaggagttygaagacttggctaatagaattatyggcttgycggcccccttcctgttgccttgcttcatctcgggtttgacgctggagatccgctgcgcagtccaggcccatcagcctatgactgtggaccaggtcgccggcctcgcgaagatccaggagcagaagttgttagaccttcgtcttcctccaccgcggtcg

SEQ ID NO: 920 - DNA, 401 bp, Artificial Sequence
  Consensus Reference Sequence
aaraaatatattagataagatgaatatttaaagataaaaataaaggatttaaattaaaagatggtaaagataaaaaagataagataagaaaaataaaagataacagaaataaaagattaagataaaaaaaaaaagataagtgataacatgctaaaaatcttcatttttgatattttctcgatcttttttttcttttaatctatcattttcatatctgcaagccataaataataaaaatatcaattcacagactaggggtgggtaaatgggtccaggtctatgaactagcccgcgrtccrtgcgagttacggaccaatttttttaaacgattcatggttatatcatatttttttgcccatcycgcttaacycgcggactatgygggtttggcccgcgaggty

SEQ ID NO: 921 - DNA, 401 bp, Artificial Sequence
  Consensus Reference Sequence
aaaagataacagaaataaaagattaagataaaaaaaaaaagataagtgataacatgctaaaaatcttcatttttgatattttctcgatcttttttttcttttaatckatcattttcatatctgcaagccataaataataaaaatatcaattcacagactaggggtgggtaaatgggtccaggtctatgaactagcccgcggtccrtgcgagttacggaccaatttttttaaacgattcatggttatatcatatttttttgcccatcycgcttaacycgcggactatgygggtttggcccgcgaggtycacgggttgctcgcagcccacattaggtttgatttgtgtgaccytgacycaattatattaggtttgattttctcttttttactttaaacttttc

SEQ ID NO: 922 - DNA, 401 bp, Artificial Sequence
  Consensus Reference Sequence
ggcttaagctacttcaaatatgraatcatttgttgttggagatgtttaaatttcatattttaratttatttcttggattttcttttgttaagacattatttattttattgatgtaattgactaattattgagattttatttacakctrtattgaacttaatttgattgtattrtatttttattaaaattgaaattctttttaaactagtcccgcggaccggcccatttgacccgtggggtctgcagggcggggggcggaccaatttatttcatccgtgtaagaagcggcgcagacggcgcgagtcggcycgcttacccacccctaccgcagacccattgggagatyagttggaggacatgattcgtgaccttggacaagagtctttccagcaagcacacgc

SEQ ID NO: 923 - DNA, 401 bp, Artificial Sequence
  Consensus Reference Sequence
ggtgttaagtctggttaatgtgaaggchagatwtgggtggagtgacaaaagtttcacctcactgcttgaggtagtgcacaatytgcttcyagaggacaacacrttgcctaaaagtwactataaggcgaaaaagatattgtgtccgatgggtatggagtatcaraagattcatgcttgyccyaatgattgcatactgtacatrcatgaattccaagaaatgtcsaaatgccctatctgtgggacttcacggtacaaagtgaaggatgaagaggaaagcagttctratgaaaactccaacaaggggcccccagcgaaggttttgtggtatcttccaatcattccaaggtttaagcatcttttttctaatgaggacracgcaaaagaccttacatggcatgcaa

SEQ ID NO: 924 - DNA, 401 bp, Artificial Sequence
  Consensus Reference Sequence
tgcgtcctgcacaggtcggtgctctgcatatggcatccagcagacgtctgggatccttagacaatccaggcrctgcctgtacgtcactatagataccttcttcatagtcttctttgtggcaatacaacggcacrcacacggtgacacctcaactgacggaaagtgctcgtagatccaacactacaggrtttacatgaaaatcatacatgttaactaaatatacactcattaaaacattgttgtaattaaattatgaaatacatgttaattacttgtaacaaggtgatgtaaccagcaagctgtcgactggtgctgagactgacatcgttaagttgatcgtacatatggacgaggccaacagctcgccatgcataccgccaagcaagattgaggtcacgtag

SEQ ID NO: 925 - DNA, 401 bp, Artificial Sequence
  Consensus Reference Sequence
agaccatcaatagttcaaccaagagcagcactgcctcgtcgctgcgcagaggctggaagtcatgcaatgcgccaacgatcgacagatggagaagagacgsgacatcgtccaacgtgatcgtaatctcccccacgggaaggtggaaactagaagtctcccggtgccacctctcgataaaggaggatataagtccctgatcgtcagtgtcaatcgaacacgagatcaaaggacttaatcctatcccaacaatcatatcctcaattgcaggaayaggtttgcctaagttatgcaccttcctcccatgggaggataacttcaactcaggacgttcctraattraagtacaaatgaacacaatttattcaaagaatgtgaatcagtaaccaataaataaataaaaa

SEQ ID NO: 926 - DNA, 401 bp, Artificial Sequence
  Consensus Reference Sequence
caccaggaaatccctcaggctcatcctcaatatcctatgcaccagtatcctgtgcgtcagtctctgcaccggtgtcctgtgcgatagcatctgccatggactcatccccagctacaacagcctctgcctctagtaccgcaggcgagtccgtaggtaccacatgcacatcatcgtcaacaatgactggtacccgtcgcctgtgtgccgatgcggtcggccttcaacgttggggagcaccgtcagtatcatcaccatccgctcctctccccagacctttggcaacaactctacctaatgcatggcctagtcctctagtcttaaccatgatttgcaaatttagaaatttagaaattttgtttatgtgtagatttttatctatttttaacgtattttaattggat

SEQ ID NO: 927 - DNA, 401 bp, Artificial Sequence
  Consensus Reference Sequence
agcattttgatggtggaaaggctcaaacacaagtgagtgaagtagttatgtgttgtttgttaggtttcctaaactcatatctagctaactaaatagctcctcaagatccaagaaagaagagtcaaagacaaacatgacaattttcagacaatattcatcaaagcaattttgataacatacaaacaaagatggcaagtggtttttattgccttcaaatctttaaatttatacttgcgaatcaagttgatccgcatgaagctcgcggatcaacttgatccacaggaagcatgcggatcaaccttttcttcttgtggatcaacctgatccgcaagttcaacacaacataattaaatacaacctacagatcatctaccctatttgcggatcacctagttcctaac

SEQ ID NO: 928 - DNA, 401 bp, Artificial Sequence
  Consensus Reference Sequence
atattattggatgccactctcatgtcatyaatatttgtacaaatgattatttttcattttctgtgtgagtgatatttgagataggaccatttgtaggcctgacttggttagtaggaaaacattcatcatgtatcttgagggtaaaggttcctgtattgaattatgtttgaaagtcttcatgtttaaataatcatataaagttatagtgttagacgttcttgctcttcctttatgctcttcatctttcgagrggtttaaaaatktagaacttatgatataagctcctttgctgaaatagttggtttatctcatgagtgtgaagtaggaagtataaaaaaaaaaaaaaaaaaaagttgctctgttgtgaagtcgtatgttctttttgtgggctttaactagtc

SEQ ID NO: 929 - DNA, 401 bp, Artificial Sequence
  Consensus Reference Sequence
tttagcctctcattgtcataggaggccttacaattgcaagaggattatgaatataaaaaggaaataaataagcaaggaaatggaggaaaggaattgtattcttgtataatttttgtgtgttttttttcttcttctctctccttcttttttttataggtgtatattaatttaattttcacgcaaccttcgtgctgagcatgcttgtcctacttagcgagtatgacggtaacctcttactaaggacatctctttccagaattagactgatttcctaaattagttctacttcctaagcgcctgagacgtgcttagcgtgccactttagaattycaatatgctctctcggaccttactttgttcactaaacatcataaattcattcacttttaatatttcataca

SEQ ID NO: 930 - DNA, 401 bp, Artificial Sequence
  Consensus Reference Sequence
  misc_feature 341: n = A,T,C or G
tcttctctctccttcttttttttataggtgtatattaatttaattttcacgcaaccttcgtgctgagcatgmttgtcctacttagcgagtatgacggtaacctcttactaaggacatctctttccagaattagactgatttcctaaattagttctacttcctaagcgcctgagacgtgcttagcgtgccactttagaatttcaatatgctctctcggaccttactttgttcactaaacatcataaattcattcacttttaatatttcatacacaaaaacttaaatgatgataaaataataattatttgtacaaaaaggaagaagtatgagaaaaaaattancaattcctatataatttaatcccaaaatatacctataaataaatttataattcaccatta

SEQ ID NO: 931 - DNA, 401 bp, Artificial Sequence
  Consensus Reference Sequence
  misc_feature 74: n = A,T,C or G
atacacaaaaacttaaatgatgataaaataataattatttgtacaaaaaggaagaagtatgagaaaaaaattancaattcctatataatttaatcccaaaatatacctataaataaatttataattcaccattaatattataatggagataagtaaaaaaaaagtaattaatgttatattgaaaaattaaaataataattgttttgagatatatttttattttttccttaataattataacagggygagagaaatatttatatataattttataaaaattccyataataatttttgtaaaatgaaaggaaaagataattatgaaatgtaatgagatataaatttttattaaaaaaatatacatttttttttcatataactctttttttccttctttctcat

SEQ ID NO: 932 - DNA, 401 bp, Artificial Sequence
  Consensus Reference Sequence
  misc_feature 29: n = A,T,C or G
aaaaggaagaagtatgagaaaaaaattancaattcctatataatttaatcccaaaatatacctataaataaatttataattcaccattaatattataatggagataagtaaaaaaaaagtaattaatgttatattgaaaaattaaaataataattrttttgagatatatttttattttttccttaataattataacagggtgagagaaatatttatatataattttataaaaattccyataataatttttgtaaaatgaaaggaaaagataattatgaaatgtaatgagatataaatttttattaaaaaaatatacatttttttttcatataactctttttttccttctttctcatcacaatatctcttattatatcctacatttttctataacattttcc

SEQ ID NO: 933 - DNA, 401 bp, Artificial Sequence
  Consensus Reference Sequence
aattacgtacccatgtaatacagtgttagttaattcacaatttttttaaaaattattattaccaaaattttatgatatcatcgatgtttatatttttatttcttatatatatatatatatataaattattacattacttaaaattatttatgaaaaataaatttaattaaatataatattcagtaactattcaagtatatttaaatataattatcaacttgtaacagagatatacttttagtttttttttagaaaatattattattagctttaaaatgttttatatatgtgatattttaaattactttgtatcacaattattatatatgttaaatatttgttttctttgaaaaaaatataaataaaattaaaacttaaaattgagattaatccatacatgc

SEQ ID NO: 934 - DNA, 401 bp, Artificial Sequence
  Consensus Reference Sequence
aaaatgttttatatatgtgatattttaaattactttgtatcacaattattatatatgttaaatatttgttttctttgaaaaaaatataaataaaattaaaacttaaaattgagattaatccatacatgcatatataatcatatttaaattttaaactacatcaatcgcacaatgaattaagaaaaccaaagattgtatcagatgatatttctctttttcaaaaccaatctactccataaactcctcggacggctattaggaaagtgaaaaggaaaatataaawaattaaaaaaataaatartttgactttgtagaagtcataatcacattctttatcattcttctcttctccatcccctcattgttrcacctgatacatttatttctttaacacgtcctat

SEQ ID NO: 935 - DNA, 401 bp, Artificial Sequence
  Consensus Reference Sequence
gcacaatgaattaagaaaaccaaagattgtatcaratgatatttctctttttcaaaaccaatctactccataaactcctcggacggctattaggaaagtgaaaaggaaaatataaawaattaaaaaaataaatartttgactttgtagaagtcataatcacattctttatcattcttctcttctccatcccctcattgttgcacctgatacatttatttctttaacacgtcctattttctgatcaatatgaaaataatatattgcctctttgttttctgatcatgctattgcactgatgtattttctgttcttatcatgattagttccacattattrttatgtcatgcacttcatctcatcatggtgcgttgcactaatattaatgatygttctayaaatc

SEQ ID NO: 936 - DNA, 401 bp, Artificial Sequence
  Consensus Reference Sequence
gattggcatttttctcatctttttgcttttaaatttaattaycgtgctaagtgagatggatataacgtagttacaacctcacaccmaatttactgtaccataataaagtgtrcctgcttcttgtagtaataatataaatagtgatgaaccacacaccttctaaaaccaaatacccatacctgtttcatattcctagtaacttagagatagaatgcaaggcttgtattattcactctcctatatatttatttaccaaactttggtggaaattttatgaagtgacaggttcatattagcttttaaccatcmatggaaaactggaaaaaagaaaaggctggcactaacaaccagttatttgtcaataggaaaggaagcttgggccaaattgaaggatgttgtgg

SEQ ID NO: 937 - DNA, 401 bp, Artificial Sequence
  Consensus Reference Sequence
ctattgactagaaatctagaaaaaaaaccatacggtaaaagcgatcacatccattcccaataaggcaggcaactcgttctccactcttcaagattctcttctacatactcaccggcaaagactaagttaatttgatgacttatcttagtttcttgcttacttgccagaaaaactttttggctagtctgattctgtttcgttcctgcagtaaggactccatctccatcaacctaagttataatcaacctcgtaactataaactttctatccaaatatgcttttataaaaattattaacatgcaattattaagtttttatatcatctcaacgtcacagtcatttccaatcacactacataaaaaatcatgatttatcggacgctaaattctttaactcggtcg

SEQ ID NO: 938 - DNA, 401 bp, Artificial Sequence
  Consensus Reference Sequence
  misc_feature 253: n = A,T,C or G
ggtgaagccagcctgtcgaaaascacatcaagraaagcagagagaaaggcaccacckaccactkctgctgccattatctcaagaacaaaagatgatcagagwagaaasacraagscaaggaattggttgctacgaactgggttggttcttggtaaggttaactgatgtgatgagatttggcttaagtttactcgttctgctgtgcaagacaaaagtacggtttatttatttattattattattatggtggtgngtgacctatcacgttggcctggatgctttttgggaktctctttacttttgttccysttcaaattactataaatttctagaatatgtttaaatataatatgtatgaaaatagtagaatattytaaaactatagtgtgtatgaatatagt

SEQ ID NO: 939 - DNA, 401 bp, Artificial Sequence
  Consensus Reference Sequence
  misc_feature 146: n = A,T,C or G
sacraagscaaggaattggttgctacgaactgggttggttcttggtaaggttaactgatgtgatgagatttggcttaagtttactcgttctgcygtgcaagacaaaagtacggtttatttatttattattattattatggtggtgngtgacctatcacgttggcctggatgctttttgggaktctctttacttttgttcctsttcaaattactataaatttctagaatatgtttaaatataatatgtatgaaaatagtagaatattytaaaactatagtgtgtatgaatatagtagagyaatttagaactataatgtgtatgaatatggtagaacaatctagaactataagtataagacagaataatctagaactatcatgataytaatctatcatgaaaa

SEQ ID NO: 940 - DNA, 401 bp, Artificial Sequence
  Consensus Reference Sequence
  misc_feature 145: n = A,T,C or G
acraagscaaggaattggttgctacgaactgggttggttcttggtaaggttaactgatgtgatgagatttggcttaagtttactcgttctgcygtgcaagacaaaagtacggtttatttatttattattattattatggtggtgngtgacctatcacgttggcctggatgctttttgggaktctctttacttttgttccygttcaaattactataaatttctagaatatgtttaaatataatatgtatgaaaatagtagaatattytaaaactatagtgtgtatgaatatagtagagyaatttagaactataatgtgtatgaatatggtagaacaatctagaactataagtataagacagaataatctagaactatcatgataytaatctatcatgaaaac

SEQ ID NO: 941 - DNA, 401 bp, Artificial Sequence
  Consensus Reference Sequence
  misc_feature 80: n = A,T,C or G
gatttggcttaagtttactcgttctgcygtgcaagacaaaagtacggtttatttatttattattattattatggtggtgngtgacctatcacgttggcctggatgctttttgggaktctctttacttttgttccysttcaaattactataaatttctagaatatgtttaaatataatatgtatgaaaatagtagaatattttaaaactatagtgtgtatgaatatagtagagyaatttagaactataatgtgtatgaatatggtagaacaatctagaactataagtataagacagaataatctagaactatcatgataytaatctatcatgaaaactctagaaagacctaaagtaatgtagaaacatttaccaccattgagaggttkgtgactttataaat

SEQ ID NO: 942 - DNA, 401 bp, Artificial Sequence
  Consensus Reference Sequence
  misc_feature 48: n = A,T,C or G
aagacaaaagtacggtttatttatttattattattattatggtggtgngtgacctatcacgttggcctggatgctttttgggaktctctttacttttgttccysttcaaattactataaatttctagaatatgtttaaatataatatgtatgaaaatagtagaatattytaaaactatagtgtgtatgaatatagtagagtaatttagaactataatgtgtatgaatatggtagaacaatctagaactataagtataagacagaataatctagaactatcatgataytaatctatcatgaaaactctagaaagacctaaagtaatgtagaaacatttaccaccattgagaggttkgtgactttataaataggcaattggtatgttgtaattaatcaatcca

SEQ ID NO: 943 - DNA, 401 bp, Artificial Sequence
  Consensus Reference Sequence
tctttacttttgttccysttcaaattactataaatttctagaatatgtttaaatataatatgtatgaaaatagtagaatattytaaaactatagtgtgtatgaatatagtagagyaatttagaactataatgtgtatgaatatggtagaacaatctagaactataagtataagacagaataatctagaactatcatgatattaatctatcatgaaaactctagaaagacctaaagtaatgtagaaacatttaccaccattgagaggttkgtgactttataaataggcaattggtatgttgtaattaatcaatccaagaaatcaatgacatagcattctttctaaaataattctctaaaactatcaattatcaactatcatctaatcaactatcaacagttt

SEQ ID NO: 944 - DNA, 401 bp, Artificial Sequence
  Consensus Reference Sequence
ttrcctaaaaatacttaactaagaattarttctaaatttaaaatttaaaatcaattcctcartstgaaagtaaatagttgaacatttactcaaatcatgttagtttatatttcaacataattttagaaaatcaagcataaaatctaatatacttaattaaaattgtcatagagatttgttgttctagaaaggtctaatagtgaaccatgwtctcataaacaattgacattagtagtagtagtttgtatttcttaatcaagtgktacaagattcaaatcatgattaatcyttacatawagaataaataaatatgaaattaaaaaatattaaaccaaaacaaaargaagtattgaacaaataaaaagaaagaatwgaacaaadgrcacatgctaattgatccc

SEQ ID NO: 945 - DNA, 401 bp, Artificial Sequence
  Consensus Reference Sequence
ccaaatcccgattggaccggtctgatctggccgattttamaaaaaaaaaaaaawagaccacttcaatggtgttgttttgatgtcttattattatcaattgttatcttggattatgaagtatggatgattttttttttttgctcaaataatgttagttatatacttatatatagttttgaatttttataatatatcaggtccaaccagtccaatgactggtccaacactaytgacccactcaccaactattttgatttggtcaatgatccaactgggttttaaaactagcttaaaacaaacataatattgatttaaaagctgattattatgtttattttaacttatgtttgattttctattttttaaaagtatttattataatgttaagtttataacaatta

SEQ ID NO: 946 - DNA, 401 bp, Artificial Sequence
  Consensus Reference Sequence
cttaacgtcaaatttgtaaattttttcctttttttttcatctgaaaattttaatttgttgccaatatgtattgacaataactcagtgcatgtgacccaagcatgaaaattggtagatagactgccaaagttaggtaacgattgtaatggaaagtggaactacatgcatctgaaaaaggtgccaactcagttatatttatacttgcctatttgaaaccttactgaattttcgttttcttcttgagtgccattaaagtctcccaactttagaagattaatttgggcagatgagtgtgaatgacttgatttgtctatgtaattcaaaacagaatgcaggtctcacttgtttgcatgttccttttttacgaatctcaagttcattattgatrtattttgttgtat

SEQ ID NO: 947 - DNA, 401 bp, Artificial Sequence
  Consensus Reference Sequence
agaagtttcaagaatttcattcaggagattagattctctgacaatcatcccaacttattaaatttgttcatctttctttcaggtgtgtctttcattgtatattctgctgctgggtaattggaaggctaaccaggtgctgyttcattccttaattattcttcaaacwttccaagaagtccatattcttcattgttctctagtgtcatcaccaaaatcarggaatgctgaaagatgcgctkgacagttamgaattccttcaccgaggctaatgagttcgtgcctccatctgagcwatccttgttcaaccttgatgacattggatstttwgtccactgtccatatctatttttbgctcgagcgactgaggtgcraagaaatctcagccattgtgcaccagatgt

SEQ ID NO: 948 - DNA, 401 bp, Artificial Sequence
  Consensus Reference Sequence
aaagacaaggatatcaatkgccaaaatcatggaaagttcttggttcaaaaggggkttagagaagyctaccattactcrgaackaagaccaagaactggctcctctggatgcattatttgtgaaaaaattgttttattatgtgaaaaaatctcatcactttaaaatttaaagttaagaacaagagaaatttataaatatttgatttctcaaccaagcaagactttatttaataataacaaaatcatgaaacaaattcaaagcaaaaagtatttcaaatatagtctacacatataaaagaatttgacatcagactaaaaatataaaactcaaatactaatttaagagtgtatttcaaattactcccttctaaactcaaatacgaataaatttaactaaaccca

SEQ ID NO: 949 - DNA, 401 bp, Artificial Sequence
  Consensus Reference Sequence
tcaaatacgaataaatttaactaaacccaaatcttttctgttaatttttttttcagcttaaaaacataacgcataaactagaaatatgattaattgttttatttgtattaaaattattttaattttaatataatattttatattacttttcttatatttattatgaagtaaaaatatttgaaaattaaagtaagaaaatagtatcataatagaaataaaataattaatactataaaaggaatgcattattttcagtgaatcttttaccattgcaaaatgaaagacatgtattaaataaatttattaatgatattagacatctaatttcatgaggttagttaagtggaatcggatatastcttgtatctagcaaattcaaggtttaagtttatatattacag

SEQ ID NO: 950 - DNA, 401 bp, Artificial Sequence
  Consensus Reference Sequence
gcattgtatcaataatgacttgtatttgttaaccaaacattaacccttacgcataaaattaaaaaaagaaagcatgttaattgatccctaaaarcataatattaatgaattaaagattttaatatctttatatatatgtatgtatgcaaaaagaaaagtgggtgatttttactaaataaaataaataaataaataatagatactaatatactataataagttttgacatgtagatatccccatgattttatatttatattaaaaaaataggcttccagatatgaaaaataggactcagagagaaggggagtgggggatacaagccagatcttgagaatggtaattaggaaaaaacaaacccagaccccctccctttcctaaggaagaacttatcatggcac

SEQ ID NO: 951 - DNA, 401 bp, Artificial Sequence
  Consensus Reference Sequence
catgtggactrgattgtgtaccaatctcaaggctgtgaactccttgccatcttktatggtctytgtcatgtctgsaatctaggcttagggatktagtttgtgagtatgattctacagtggctcttaaactcatcttrgaagraaccagcaagtttcaccctcatgctaccctcatcaactcaattaatcaactttctggcgaaagcaacgtctgtgcaaattggcttgctaatttaagtttggagcctcaagctastgataattcatttctggtttggcaacattgcccacctaaactrkctttgtctcttttagmagatgcaggywgagattcttattagattgtgtacgygtgtttagtttgctttgcttttttaagttttctgatgcataaaaaatta

SEQ ID NO: 952 - DNA, 401 bp, Artificial Sequence
  Consensus Reference Sequence
tggtgtcctcattggtccacagacatccrtatttatcagctccaatagatctttcgctctccatgctccacttgttgagaaaggaaatcagtgttgcttaccaaggagacatccttcacacactccattgttctcctttatgcttggaagatctctcatcatgttcttctcatgtaacaacttcaaggcgtgtgtgttgatgtggccaaatcttcgatgccatagccatgaatcatcaacttgtaccttcatggcaatgtttgttgcatattttaaatttwgagggaagcttctattgctcttattcatctttacttgggctatatctcagaccttttatttttgttgtctaagattttgcatacacctccttcaaagtgaagtgtgtagtctctctccat

SEQ ID NO: 953 - DNA, 401 bp, Artificial Sequence
  Consensus Reference Sequence
tacatccactatccaagtaccagcttcctcccttttcttttattgagtattgagtggcatagaacatacattattcttgatcatgctcctttgcgatattggcttgatgcctatttttgttgcgacaatttttctctatgtgcccgaacttcttgcaatggttgcattgtggcatattacagaaccaacaatttttctcttcgtgaccttgccttttgcatatattgcatggaagatttttatctrttttgttcttaaggaaattcctagaaccttctcttcttytggaagtttctccataattttttttcctccattttctttgttttggggatgaaatttaaactttgactggaaggcattttcaagtgtatcttttttatgcctatacagtctttgct

SEQ ID NO: 954 - DNA, 401 bp, Artificial Sequence
  Consensus Reference Sequence
agtattgagtggcatagaacatacattattcttgatcatgctcctttgcgatattggcttgatgcctatttttgttgcgacaatttttctctatgtgcccgaacttcttgcaatggttgcattgtggcatattacagaaccaacaatttttctctkcgtgaccttgccttttgcatatattgcatggaagatttttatctgttttgttcttaaggaaattcctagaaccttctcttcttytggaagtttctccataattttttttcctccattttctttgttttggggatgaaatttaaactttgactggaaggcattttcaagtgtatcttttttatgcctatacagtctttgctcatatgcttcaagagagcccacaagttctgtccttgatagagtgg

SEQ ID NO: 955 - DNA, 401 bp, Artificial Sequence
  Consensus Reference Sequence
gatctttggtttccccaatcgttgtcacgattgggktaaatttttggggcatagtaattagaattttctcaataattttcttgtcaagaatatcctccccaaaagctctcatttgattaactatttctttaactttagaatagtaatctttaackktctgagactccttcatctttaatagttcaaaatctcttcttaaagattgaattttaacggcacgtaccttaacacttccttgaaactcctcgtgcaatgtgttccatgcttctttagcagtcttagctcccataattcttgggaaaattggatcastcaccgcttgttgcaaggtgaacaacgcctttgaatttttctgtttatttttcttcaactctttttcttgagatgcattaagaactgaa

SEQ ID NO: 956 - DNA, 401 bp, Artificial Sequence
  Consensus Reference Sequence
tttgattaactatttctttaactttagaatagtaatctttaackktctgagactccttcatctttaatagttcaaaatctcttcttaaasattgaattttaacggcacgtaccttaacacttccttgaaactcctcgtgcaatgtgttccatgcttctttagcagtcttagctcccataattcttgggaaaattggatcagtcaccgcttgttgcaaggtgaacaacgcctttgaatttttctgtttatttttcttcaactctttttcttgagatgcattaagaactgaagtatccrcggaacagtgaagccttcttctactatgtttccattttaacacgccagaaagcataattttcaccattgaagatagggacaaaaatagttgacaattgagtagt

SEQ ID NO: 957 - DNA, 401 bp, Artificial Sequence
  Consensus Reference Sequence
ttttaacggcacgtaccttaacacttccttgaaactcctcgtgcaatgtgttccatgcttctttagcagtcttagctcccataattcttgggaaaattggatcastcaccgcttgttgcaaggtgaacaacgcctttgaatttttctgtttatttttcttcaactctttttcttgagatgcattaagaactgaagtatccgcggaacagtgaagccttcttctactatgtttccattttaacacgccagaaagcataattttcaccattgaagatagggacaaaaatagttgacaattgagtagtgttatccatagcttagaaaaaatattattggagtaggttaatagtacaaaggaaatttttgaagtagttgggagggttttggaatagtaggtaggt

SEQ ID NO: 958 - DNA, 401 bp, Artificial Sequence
  Consensus Reference Sequence
cakatgtrtgrcatgtattttatgtctcaaaacacttatgtgaattttattatgtaatacatgttttgaattcattggattcttatgtatcatctgtgccaatttttatgggcttaacatctctgactgaaatgagcaagtccaatttcacctcggtgttttggatcatgatcttgctatgttggaagagaagtttgttattattattgatgctagtagcaataaagagaaagttcattataaagcttgggaaagatctaacagactcaacctaatrttgatgaaaatgactgttgcagacagtattaagacaactctccctaaaatcgaaagtgctaaaagttttatgggattagtgggagagcgctctcaaacagctgataattctgttgctgggacat

SEQ ID NO: 959 - DNA, 401 bp, Artificial Sequence
  Consensus Reference Sequence
taatrttgatgaaaatgactgttgcagacagtattaagacaactctccctaaaatcgaaagtgctaaaagttttatgggattagtgggagagcgctctcaaacagctgataattctgttgctgggacattaatgagtacattagccaccatgaagtttgatggttcacatactatgtatgaacatgtcattgagatgatagatattgcagcaagacttaagaccttgggaatataatggctgtgaatgagaaccttcttgttcaatttattctaaactcattaccgtctgagtttggcctgttctaaatgaactataataccatgaaagataaatggratgtgcatgaattgcacagtatgttagttcaggaagaaacgaggcttaagaatcaakgaagtc

SEQ ID NO: 960 - DNA, 401 bp, Artificial Sequence
  Consensus Reference Sequence
tgagtattatggaagatatgatgaaactggryaacacccaggtccatttgctaagcttcttcaaaaacgtggcatttgtgcacaatacacaatgtctggtacaccaccacaaaatgatgtatcagaaaggcgtaatagaacattaatggatatgattaggagtatgttaatcaatttgactttacccgtatctttgtggatgtatgccttgaaaactaccatgtatttgttgaatagagttcctagtaaggcagttccaaagasacctttgaactgtggacaaatagracacctagtataaggcacctgcatgtttggggttgcyagrcagaaataagdatttayaatccgcaagaaagaaaattggatgcaagaacaatcagtggctatttcattggtta

SEQ ID NO: 961 - DNA, 401 bp, Artificial Sequence
  Consensus Reference Sequence
cttaagtgtkttttttagttattcatttcttgattataaaaaaaaattagtcagtgaatgaacagagaactacactttaattgaaagtaatttataatcatttattattattatttaatttcaagtatgcactcaaaacaattgcactttatagtcactactaaaataaagactttttatgacacacttttaaaatcggttgcaacatgactgtcgtagtattaggggcggtagcatttttataaatatcttatatattcaacgacgtttttgtttaggaccgttttcgtatgctaacgaaaaaattgactaagacagtgtatattaaacatgtccttgaaatcactaaaaacaaatacgggcttcaatatgcaccctcgttaaccaagttttataaaagc

SEQ ID NO: 962 - DNA, 401 bp, Artificial Sequence
  Consensus Reference Sequence
cggtagcatttttataaatatcttatatattcaacgacgtttttgtttaggaccgttttcgtatgctaacgaaaaaattgactaagacagtgtatattaaacatgtccttgaaatcactaaaaacaaatacgggcttcaatatgcaccctcgttaaccaagttttataaaagcttcttgtcccgtgagtgagtgagtttttgagtgaacgaaaacttccgaygctagatcttccttgtgagtgagcttctgagtgaaccttcgaaaacttcccgcactacatctcgcaacaccttcacacctctgacaattatgtgttcgaaataataggtgcaggcaagacctgcaatctctaaaygcttaatagttatgtttagaaaataactactttagaaatcatct

SEQ ID NO: 963 - DNA, 401 bp, Artificial Sequence
  Consensus Reference Sequence
ccaagttttataaaagcttcttgtcccgtgagtgagtgagttttygagtgaacgaaaacttccgaygctagatcttccttgtgagtgagcttctgagtgaaccttcgaaaacttcccgcactacatctcgcaacaccttcacacctctgacaattatgtgttcgaaataataggtgcaggcaagacctgcaatctctaaatgcttaatagttatgtttagaaaataactactttagaaatcatctatgtattaaaaacttcagggtgacagttatgtctcaattgctactgtttaaaacataccggtatgttttataatatgaaatgtttcaattaattttaggtaggagcatgtggttcaaatgtctgcatatatgttgatcaagaggttggtaaattaa

SEQ ID NO: 964 - DNA, 401 bp, Artificial Sequence
  Consensus Reference Sequence
agcttacatcagaaccgtttttgaaagttagcattctaaaacggtgtttaccttagcaacgtcttaaaatgcttactttcaaagacggtgtttaccttagcaacgtctttgaaagtaagcattctaargcggtgctcacatcagcaacaacaacgtcttagactgtctactttcaaagacgttgttgaagtaagcaccgttttagaaagctgctcactttctaagacagtgttttggaactcgtcgttgaaatttttaaacttcgacgacgtcacattcaacgacattcaaacgtcgttgtatattctatttgaccgtcgttaaagcactttcttatagtagtgagttaattatgtttttgcttttgataacatcawtgtttatggmtaattttaaacatt

SEQ ID NO: 965 - DNA, 401 bp, Artificial Sequence
  Consensus Reference Sequence
agtgatgaatcacataccttctaaaaccaaataccgatacctgttttatatacctagtaacttagaggcaaattttcccattcgggatacttttaaaaagtatttccccagatggggttgttttaaaagatattccggcaagggaaacttttgcacgtaaagtgcatgcatggcccaagcaaaccgcyagtgggactggctggttctctgctggtgaaggactcgccactgcgaatggcgatatgcacatgcaaggggaaccgccagtttgactggcgagttcccaccacgtaggctcagggctaggcgtyaggccatgcaggtgcagcaggcgcaggtgcagagagtgcaagagggaatcaccattctcattgccgggttgggctttgcgggaatcgcca

SEQ ID NO: 966 - DNA, 401 bp, Artificial Sequence
  Consensus Reference Sequence
  misc_feature 185: n = A,T,C or G
ttaaattrtatgttattagttgtgttatatatatatatatgttaggttagttttagttaatttgataatattatttttttaaaattttgtaaattagtatagtattaattgttttatatatagatatgctaagtttgttgatgttaggtgaaacttttaaattttaagtagtaygttcaaatatnaatatkatttrtgttctatgtatatgttacaaatttkagttggtatattattatttgtacgttagttgtagttgatttattaatatgattttgttaagatttttwaaatttgtatgttattatttgtgataaaattatttgtacgttaattttagttgttatgttattgttatttrgtttagatttattaggtttgtatgatattatttgtattat

SEQ ID NO: 967 - DNA, 401 bp, Artificial Sequence
  Consensus Reference Sequence
  misc_feature 25: n = A,T,C or G
attttaagtagtaygttcaaatatnaatatkatttrtgttmtatgtatatgttacaaatttkagttggtatattattatttgtacgttagttgtagttgatttattaatatgattttgttaagatttttwaaatttgtatgttattatttgtgataaaattatttgtacgttaattttagttgttatgttattgttatttggtttagatttattaggtttgtatgatattatttgtattatatatatggtattttaggtttagttagaatgtgaatattatttagtttatttaattatagtttttattgaaatatatgatactttattaatattatatatatacgttgtttaaattttttattccataataatttttttatttattaccatttttgtgtat

SEQ ID NO: 968 - DNA, 401 bp, Artificial Sequence
  Consensus Reference Sequence
atttgtagagtattttagagmatttatttaaatttgtgtacatattattatttttaattttgttatttgtttaaattgatgtattttgttatttgttcaaattgatgtattttgttatttgttcagattttaattatgtggtatrtatatttaattgattttttgtaactgtagttaattattttaatgtaaaatttttgttgtcaattttttgtattatattttattttacagtatcaatggcatcttcgtcgtcatcttcatctagtatacwcattaagtctrgtccaatagatwgagacgttttatggatgcaagctaaacatgtttcagaacatgtttggaacggggaatcagacagaaaattacacatcagacgagytgtccccatctatcaagga

SEQ ID NO: 969 - DNA, 401 bp, Artificial Sequence
  Consensus Reference Sequence
  misc_feature 83: n = A,T,C or G
tagttgtttttwaaaaaaaagtcatttgaaaataatcaataatgtaacgcatcgccactaattatttcatattttttttgtangtggctgcgacgtggaaaccaacatattggcaatgatgatctaatagttttycgtcgcaaattggatatcatgaaacgacatgaggtaagaaratyrttatgtattcgttaaataatgaataaaatgtcatgtttaagtcaaaattaacaattgtgttattgtatgmagtttctgtgggasycttacacarcaactgttatgtcaatgttgcctcccatttgtttggttggtagtgtggcgtggtgcgcagtggtkccactcatttgtttccatgttgtagagtggcaccaacccaatagagtgttgcgacaatttgg

SEQ ID NO: 970 - DNA, 401 bp, Artificial Sequence
  Consensus Reference Sequence
  misc_feature 10: n = A,T,C or G
ttttttgtangtggctgcgacgtggaaaccaacatattggcaatgatgatctaatagttttycgtcgcaaattggatatcatgaaacgacatgaggtaagaaratyrttatgtattcgttaaataatraataaaatgtcatgtttaagtcaaaattaacaattgtgttattgtatgmagtttctgtgggasycttacacagcaactgttatgtcaatgttgcctcccatttgtttggttggtagtgtggcgtggtgcgcagtggtkccactcatttgtttccatgttgtagagtggcaccaacccaatagagtgttgcgacaatttggaatgcaacaacctatttcagagtctccttcgtaaccatagaatatccatgggctaacgctgaaaggcaaacaa

SEQ ID NO: 971 - DNA, 401 bp, Artificial Sequence
  Consensus Reference Sequence
agttaggttttagggcttaggtttrgggtttagggttagtggttagggttagggtgtaggttttggggtttgggtttagggtgtaggttttagggtttgggtttatgtttatgtttttaactaagtccatagttcatcattgtatatagttctcctttagtatcaatttgaataccctttcatcattgtagatagttctcttttagtatcaatttgaataaccttaactacarcattkgactccccactttcactaagcctaggtttagggtttagtgtttagggkttrgggtttaggggttagggtttgtggtttagtgcttagggtttagggtgtaggccttaggstttagggkttattggttagggtttggggtttaggatttagggtttggggttta

SEQ ID NO: 972 - DNA, 401 bp, Artificial Sequence
  Consensus Reference Sequence
kgactccccactttcactaagcctaggtttagggtttagtgtttagggkttrgggtttaggggttagggtttgtggtttagtgcttagggtttagggtgtaggccttaggstttagggkttattggttagggtttggggtttaggatttagggtttggggtttagcgtttaggggtttggggtttagtgtttagggtttatgatttagggtttatggtytagggcttagggttttgggttaggggttatatttagggcttagggtttwgggtgtaggtttttgtctttacagtttagggtttaggktttagggttagggtttatgtttatgtttttaactaacgaattcattgaacccsrcaaataagtaatgtacagaaaccaaaatgttattaactaac

SEQ ID NO: 973 - DNA, 401 bp, Artificial Sequence
  Consensus Reference Sequence
aagcctaggtttagggtttagtgtttagggkttrgggtttaggggttagggtttgtggtttagtgcttagggtttagggtgtaggccttaggstttagggkttattggttagggtttggggtttaggatttagggtttggggtttagcgtttaggggtttggggtttagtgtttagggtttakgatttagggtttatggtttagggcttagggttttgggttaggggttatatttagggcttagggtttwgggtgtaggtttttgtctttacagtttagggtttaggktttagggttagggtttatgtttatgtttttaactaacgaattcattgaacccsrcaaataagtaatgtacagaaaccaaaatgttattaactaacgaattcattgaaccccac

SEQ ID NO: 974 - DNA, 401 bp, Artificial Sequence
  Consensus Reference Sequence
ggtttgtggtttagtgcttagggtttagggtgtaggccttaggstttagggkttattggttagggtttggggtttaggatttagggtttggggtttagcgtttaggggtttggggtttagtgtttagggtttakgatttagggtttatggtytagggcttagggttttgggttaggggttatatttagggcttagggttttgggtgtaggtttttgtctttacagtttagggtttaggktttagggttagggtttatgtttatgtttttaactaacgaattcattgaacccsrcaaataagtaatgtacagaaaccaaaatgttattaactaacgaattcattgaaccccacaaattmaatacattgaacadaacttaaacwaatacaagtcactcgacta

SEQ ID NO: 975 - DNA, 401 bp, Artificial Sequence
  Consensus Reference Sequence
tatttagggcttagggtttwgggtgtaggtttttgtctttacagtttagggtttaggktttagggttagggtttatgtttatgtttttaactaacgaattcattgaacccsrcaaataagtaatgtacagaaaccaaaatgttattaactaacgaattcattgaaccccacaaattmaatacattgaacadaacttaaactaatacaagtcactcgactaatatacattaatcaatgatttgaacaacttccatgctcagattgcattggacagcgacgcctgttatgaccttcggctccacatctactacattttgccggtgctcagatggttcgacccaatccatctcattccttatccttgtkgattttggcckacctttcgcacgaattgtagttgg

SEQ ID NO: 976 - DNA, 401 bp, Artificial Sequence
  Consensus Reference Sequence
ccccacaaattmaatacattgaacadaacttaaacwaatacaagtcactcgactaatatacattaatcaatgatttgaacaacttccatgctcagattgcattggacagcgacgcctgttatgaccttcggctccacatctactacattttgccggtgctcagatggttcgacccaatccatctcattccttatccttgttgattttggcckacctttcgcacgaattgtagttgggtcagggataagtgkccatgcgtcatyagaaggagraatagcygyttcattcccaagaggccacyattgtgcggwgtaagcttttaagatgtgctcatttgtrtaaamaacatctatatattggtagtagttcatgctcacrtaaccacaagctgcaataatgtg

SEQ ID NO: 977 - DNA, 401 bp, Artificial Sequence
  Consensus Reference Sequence
caagctgcaataatgtgtgaacatggatartgaarcgcakaataccttccgcattgataatgawgatcattcaagttaactgcccacttttgtccgccacgttgtgttatagggttgaagctctcctctacttcaawccttgtggagtggatatcatacacgcgaacgatgtgcgtacaagcttgttcttgatttttccttagttctttaacaagctttraacaatatacttgtccttcatataactgcctttgggcttggcggccacgctcaacaaagtactttcgacacctactgtacgttgatttgaccaatgttgttatgrgaatgttgcgacaatcctttaaaaccttattgatacattctgagaagttggttgtcatgtggccatatcgacgtct

SEQ ID NO: 978 - DNA, 401 bp, Artificial Sequence
  Consensus Reference Sequence
aacatggatartgaarcgcakaataccttccgcattgataatgawgatcattcaagttaactgcccacttttgtccgccacgttgtgttatagggttgaagctctcctctacttcaawccttgtggagtggatatcatacacgcgaacgatgtgcgtacaagcttgttcttgatttttcctyagttctttaacaagctttgaacaatatacttgtccttcatataactgcctttgggcttggcggccacgctcaacaaagtactttcgacacctactgtacgttgatttgaccaatgttgttatgrgaatgttgcgacaatcctttaaaaccttattgatacattctgagaagttggttgtcatgtggccatatcgacgtctgttagctctttggcaagtg

SEQ ID NO: 979 - DNA, 401 bp, Artificial Sequence
  Consensus Reference Sequence
cctctacttcaawccttgtggagtggatatcatacacgcgaacgatgtgcgtacaagcttgttcttgatttttcctyagttctttaacaagctttraacaatatacttgtccttcatataactgcctttgggcttggcggccacgctcaacaaagtactttcgacacctactgtacgttgatttgaccaatgttgttatgggaatgttgcgacaatcctttaaaaccttattgatacattctgagaagttggttgtcatgtggccatatcgacgtctgttagctctttggcaagtgtaccaaatygctcgtagtaataatttctyggtaagccgagtgtygtaccacagggattttgttgcacttatgtgaagtacttttcagtttgcaaattgtaaattt

SEQ ID NO: 980 - DNA, 401 bp, Artificial Sequence
  Consensus Reference Sequence
tgatgcctcatgatgacaagcctaccttaattacctatcttccaaatgccctttgcaaagactcgataactaagatgcattaagattgaattctagatgtttgctaaagcacgggcatcgggtcaatgctaaccctatgatttatttcttttattgttctattaagcgttaccctctcycgagtggactaacccttaaaatagattcacgtattcattccttacccctaattaggctttaccctatcccgagtrgactaaagactaacagaaaataaagtctgagatacaaaataaataagaaagaaaagcagataaaagaacctagaaggaaaccctctaaatgataacccgatgatttcttccttttttgttctattaagcgttaccctctcccgagtg

SEQ ID NO: 981 - DNA, 401 bp, Artificial Sequence
  Consensus Reference Sequence
ggaaatcctctttttattgataactcttgaaatgctccatacatcattggctatttaggcctgccaggccctagctaggggtttagtcactcatagtcatgagggytttacaatgagatggggggggkgaaagaaaggtaataagaatataagaaaagggaaggaaaaggagagaactgagtgccaaaagtctgaaaactgagctytgaggaagtgtgttcattttcctaggctgaccctcttatttataggtgcaaaattgggctttgggccttcgtagtctcgctgagcatgaagcctcacgctcagcaccacctcgcgctcaacgcgtgtcgtgcgcttagcgtcttgccttmttgcrtgctgggcacgtcttrtgccttgctggacttgagcttctt

SEQ ID NO: 982 - DNA, 401 bp, Artificial Sequence
  Consensus Reference Sequence
ctgagtgccaaaagtctgaaaactragctytgaggaagtgtgttcattttcctaggctgaccctcttatttataggtgcaaaattgggctttgggccttcgtagtctcgctgagcatgaagcctcacgctcagcaccacctcgcgctcaacgcgtgtcgtgcgcttagcgtcttgccttmttgcrtgctgggcacgtcttgtgccttgctggacttgagcttcttctgattttcttctttttttctttatttatgctcctttttgcttgttgtacctccctttttcacatctgcagtcaaaattcaaaattaattaaatctttccaaattaaagcataaataactgctaaataattaattctaagttaatytcagaccgattttccactattaattcacta

SEQ ID NO: 983 - DNA, 401 bp, Artificial Sequence
  Consensus Reference Sequence
agcatgcattccaaaaatttaagttcttgccaagacctatttcccacttagccccttttgccttcwgcactttccactgacacctctctttttcatttttdccctttttcttcttcttatttatttcttttcttttcttttctttttttttttaaattttaataataayaataataataataataataatgggctcataattatttagaggtgttctagtgtgtgctattaccttgkctactttacccatttgttcaaaatcccccaaattaaggccttattagcattcgaaaccctactgctctcttagaatcctacacaaggycaggaatatcaaatttttttttkgcttagggttctactcaaaataaatcattataattctttggctcaatatgggt

SEQ ID NO: 984 - DNA, 401 bp, Artificial Sequence
  Consensus Reference Sequence
ctatttcccacttagccccttttgccttcwgcactttccactgacacctctctttttcatttttdccctttttcttcttcttatttatttcttttcttttcttttctttttttttttaaattttaataataayaataataataataataataatgggctcataaytatttagaggtgttctagtgtgtgctattaccttgtctactttacccatttgttcaaaatcccccaaattaaggccttattagcattcgaaaccctactgctctcttagaatcctacacaaggycaggaatatcaaatttttttttkgcttagggttctactcaaaataaatcattataattctttggctcaatatgggtgcaagggataaaattatgttgggttggctttttggt

SEQ ID NO: 985 - DNA, 401 bp, Artificial Sequence
  Consensus Reference Sequence
cgcctcccaaatctgcccatgggccccaatcagtgccagctaagtcaaccatgaggtcctcatcaactgcaggatcctccgtagcggcggctctagaaggcccttcccccctgtcrgtggagggctggtctcctrgccaggygacctgctgacgataggcctccggagtcgtgagcgacgaatccatctgcaagtggagggacaagcgatgcaggtcctgaawgatgatctgctgtccctggtacaagtacctgagcatttgtccctgcatgtctgaaggtgcggcagttgatggaagyggaggctgtggtcgcwaggaggaaggttgagaagtagggggtgcctcagatgtggatgctggtgctytggtgcgagtccggygggcccctggaaatgtaatg

SEQ ID NO: 986 - DNA, 401 bp, Artificial Sequence
  Consensus Reference Sequence
ggcccttcccccctgtcrgtggagggctggtctcctrgccaggygacctgctgacgataggcctccggagtcgtgagcgacgaatccatctgcaagtggaggracaagcgatgcaggtcctgaawgatgatctgctgtccctggtacaagtacctgagcatttgtccctgcatgtctgaaggtgcggcagttgatggaagtggaggctgtggtcgcwaggaggaaggttgagaagtagggggtgcctcagatgtggatgctggtgctytggtgcgagtccggygggcccctggaaatgtaatggatggatcggcggagttccaaaaattcttcttcacgtatgcaaggttgatcgtagggctgagtgactcaaagatyagggtatcagaaaccaccccytg

SEQ ID NO: 987 - DNA, 401 bp, Artificial Sequence
  Consensus Reference Sequence
crgtggagggctggtctcctrgccaggygacctgctgacgataggcctccggagtcgtgagcgacgaatccatctgcaagtggaggracaagcgatgcaggtcctgaawgatgatctgctgtccctggtacaagtacctgagcatttgtccctgcatgtctgaaggtgcggcagttgatggaagyggaggctgtggtcgctaggaggaaggttgagaagtagggggtgcctcagatgtggatgctggtgctytggtgcgagtccggygggcccctggaaatgtaatggatggatcggcggagttccaaaaattcttcttcacgtatgcaaggttgatcgtagggctgagtgactcaaagatyagggtatcagaaaccaccccytgaatgtcacacaacgtt

SEQ ID NO: 988 - DNA, 401 bp, Artificial Sequence
  Consensus Reference Sequence
gaaggtgcggcagttgatggaagyggaggctgtggtcgcwaggaggaaggttgagaagtagggggtgcctcagatgtggatgctggtgctytggtgcgagtccggygggcccctggaaatgtaatggatggatcggcggagttccaaaaattcttcttcacgtatgcaaggttgatcgtagggctgagtgactcaaagattagggtatcagaaaccaccccytgaatgtcacacaacgttgtgaacaacgccgggaacccaagccgcgaggtactggactgggcaatctgactgatctgctgagatataaagytgcccacgtccatatccatccatctcactaagtcgtagatcaagcgtgccctgtcaagattaacatcagatgtgtgagaagtgggtgc

SEQ ID NO: 989 - DNA, 401 bp, Artificial Sequence
  Consensus Reference Sequence
ctggaaatgtaatggatggatcggcggagttccaaaaattcttcttcacgtatgcaaggttgatcgtagggctgagtgactcaaagatyagggtatcagaaaccaccccytgaatgtcacacaacgttgtgaacaacgccgggaacccaagccgcgaggtactggactgggcaatctgactgatctgctgagatataaagttgcccacgtccatatccatccatctcactaagtcgtagatcaagcgtgccctgtcaagattaacatcagatgtgtgagaagtgggtgcaagatcataataagaraggacactccatgtctgagsrrgtgtcgtcatgtccttcctcaacagcttccaggggagaccatcgacgtttagaatgaaatgcccccctggagta

SEQ ID NO: 990 - DNA, 401 bp, Artificial Sequence
  Consensus Reference Sequence
gttgtgaacaacgccgggaacccaagccgcgaggtactggactgggcaatctgactgatctgctgagatataaagytgcccacgtccatatccatccatctcactaagtcgtagatcaagcgtgccctgtcaagattaacatcagatgtgtgagaagtgggtgcaagatcataataagaraggacactccatgtctgagsgrgtgtcgtcatgtccttcctcaacagcttccaggggagaccatcgacgtttagaatgaaatgcccccctggagtacatattgtggcggcgatggtgtcaggatcgggatgagtgctgggatatctggtgtaggctgggtactcctcaccatcctcttggatgactggggtgtcgaggaattcgttaatcgtgtcagcgtt

SEQ ID NO: 991 - DNA, 401 bp, Artificial Sequence
  Consensus Reference Sequence
gggggtgcagaaagtaggtagaaggggtgtagagagtagaagtgggggtgcaaagagtaaagcgcgagggctgatgggccctaagactagccccgcgcttggcgccccctgcacactgttgctggcacgcgcttagcgccaagggtgggcgcttagcgcgttcgctgatctttaagagcgcgcttagygcgcagcgccgcgcttaacgggctcgtccttatggcctcyagtccgtcagcattcgctaagccttgagcaaggcttagcgcaatgagacctgtgtattcatacaaacagcaatgcatagaaaatttcgttaccttcgttagtgactattttgcgtgagagattcagtaattaagcaagggtgatgaaaagaggtgaaagggggtgagatttgc

SEQ ID NO: 992 - DNA, 401 bp, Artificial Sequence
  Consensus Reference Sequence
tgtagagagtagaagtgggggtgcaaagagtaaagcgcgagggctgatgggccctaagactagccccgcgcttggcgccccctgcacactgttgctggcacgcgcttagcgccaagggtgggcgcttagcgcgttcgctgatctttaagagcgcgcttagygcgcagcgccgcrcttaacgggctcgtccttatggcctctagtccgtcagcattcgctaagccttgagcaaggcttagcgcaatgagacctgtgtattcatacaaacagcaatgcatagaaaatttcgttaccttcgttagtgactattttgcgtgagagattcagtaattaagcaagggtgatgaaaagaggtgaaagggggtgagatttgcgcagaaaggaaggaagaatgacgaaat

SEQ ID NO: 993 - DNA, 401 bp, Artificial Sequence
  Consensus Reference Sequence
cgtgagagattcagtaattaagcaagggtgatgaaaagaggtgaaagggggtgagatttgcgcagaaaggaaggaagaatgacgaaatgaggcgcctacgatttaataccgttgaagaggcaactgaggagttgggcagtttcaaaaactgcccaagaatttatggtactcgcgcttagcgcacatgtggccgctaagcgtgccaagggaagcgtcccttggttgcccctcagattcaaaattcaaatcttggaaaacatacctgggtgcttagcgcgtagtcgcgcgctaagcgcgtggcttcgtgyagcccacttyaatttgctattggtacccctccttttgctgtcttcacctgttgggcctttgcttttcgtaccccctgtttgctgtttgcacct

SEQ ID NO: 994 - DNA, 401 bp, Artificial Sequence
  Consensus Reference Sequence
accgttgaagaggcaactgaggagttgggcagtttcaaaaactgcccaagaatttatggtactcgcgcttagcgcacatgtggccgctaagcgygccaagggaagcgtcccttggttgcccctcagattcaaaattcaaatcttggaaaacatacctgggtgcttagcgcgtagtcgcgcgctaagcgcgtggcttcgtgtagcccacttyaatttgctattggtacccctccttttgctgtcttcacctgttgggcctttgcttttcgtaccccctgtttgctgtttgcacctgtttgcycccccccccccttttttaaaacaaaaaaatagaaaataaaaaatgcaaaatataataaagacaraatataaatacctacgattaccttaaataaatatgt

SEQ ID NO: 995 - DNA, 401 bp, Artificial Sequence
  Consensus Reference Sequence
aggcaactgaggagttgggcagtttcaaaaactgcccaagaatttatggtactcgcgcttagcgcacatgtggccgctaagcgygccaagggaagcgtcccttggttgcccctcagattcaaaattcaaatcttggaaaacatacctgggtgcttagcgcgtagtcgcgcgctaagcgcgtggcttcgtgyagcccactttaatttgctattggtacccctccttttgctgtcttcacctgttgggcctttgcttttcgtaccccctgtttgctgtttgcacctgtttgcycccccccccccttttttaaaacaaaaaaatagaaaataaaaaatgcaaaatataataaagacaraatataaatacctacgattaccttaaataaatatgttgggttgcct

SEQ ID NO: 996 - DNA, 401 bp, Artificial Sequence
  Consensus Reference Sequence
tgcttttcgtaccccctgtttgctgtttgcacctgtttgcycccccccccccttttttaaaacaaaaaaatagaaaataaaaaatgcaaaatataataaagacaraatataaatacctacgattaccttaaataaatatgttgggttgcctcccaaccarcgcttagtttaatgtctttagctagacatagggcttctttcaaggatcttttaagtgcatgacggtcgtcaacttctctagttgtcctccatwktagatctttaagcgytgtcygttgacgatccatttcttctcataattttctactcgagggtccaccaatkctaccrctccrtgaggtctgatttctttartaatgaacgrtcctraccactttgacttcagctttcytgggaatagt

SEQ ID NO: 997 - DNA, 401 bp, Artificial Sequence
  Consensus Reference Sequence
ttttttaaaacaaaaaaatagaaaataaaaaatgcaaaatataataaagacaraatataaatacctacgattaccttaaataaatatgttgggttgcctcccaaccarcgcttagtttaatgtctttagctagacatagggcttctttmaaggatcttttaagtgcatgacggtcgtcaacttctctagttgtcctccattktagatctttaagcgytgtcygttgacgatccatttcttctcataattttctactcgagggtccaccaatkctaccrctccrtgaggtctgatttctttartaatgaacgrtcctraccactttgacttcagctttcytgggaatagtctcaachtggarttgaagagtagtacctgctgccctggctggaattctttct

SEQ ID NO: 998 - DNA, 401 bp, Artificial Sequence
  Consensus Reference Sequence
tttttaaaacaaaaaaatagaaaataaaaaatgcaaaatataataaagacaraatataaatacctacgattaccttaaataaatatgttgggttgcctcccaaccarcgcttagtttaatgtctttagctagacatagggcttctttmaaggatcttttaagtgcatgacggtcgtcaacttctctagttgtcctccatwttagatctttaagcgytgtcygttgacgatccatttcttctcataattttctactcgagggtccaccaatkctaccrctccrtgaggtctgatttctttartaatgaacgrtcctraccactttgacttcagctttcytgggaatagtctcaachtggarttgaagagtagtacctgctgccctggctggaattctttctt

SEQ ID NO: 999 - DNA, 401 bp, Artificial Sequence
  Consensus Reference Sequence
ccatgaagtctatgccccagcagtcgaagatctcaacttccattacattttgtaatggcatttcattccttcgtgagattccccatgtcctttggcatctatcgcaatatygcacaaactcgtgggcatctttaaaaatggagggccagaaaaaacccgattgtakcacttttgccgccrttctatccccattgtgatgatcaccatagagtgaactgtggcagtgccaaagaatatttcacgcttcttccttcttaacaaattaccagcccctaccttgaataaatgaggatcatcctagacatagaagtgtgaatcatgcaagaatttcttcttctgattccaatcaaattcttctggaatgatcccggtggytttatagttggccatgttcgcaaacc

SEQ ID NO: 1000 - DNA, 401 bp, Artificial Sequence
  Consensus Reference Sequence
aactgtggcagtgccaaagaatatttcacgcttcttccttcttaacaaattaccagcccctaccttgaataaatgaggatcatcctagacatagaagtgtgaatcatgcaagaatttcttcttctgattccaatcaaattcttctggaatgatcccggtggytttatagttggccatgttcgcaaaccaaggtcgagtgttggcctgtaagaggaattcgtcakggaattcgccttttacctctgsttcctccttggtgatctcctcattcttcaatctggacaaatggtcagccactacgttttcggatcctctcttatcctkgatggtgatatcaaattcttgtagcaacaagacccatctaattaatctyggcttcgaatccgccttagctagcaaat

SEQ ID NO: 1001 - DNA, 401 bp, Artificial Sequence
  Consensus Reference Sequence
tcagccactacgttttcggatcctctcttatcctkgatggtgatatcaaattcttgtagcaacaagacccatctaattaatctyggcttcgaatccgccttagctagcaaatgcttgatggcrrcatggtcagtgaagatgatgacccttgatcctatcaagtaagaccgaaacttttctaagacaaaaacaatggccaatatctctttctctgtagtggcgtaatttaattgygcctcgtttaggacyttrctggcataatatatggcgtgaaaaaccttgtcatgcctttgtccyagaactgcacctactdcataatcgctagcatcacacatcaattcaaaatcyttgctccaatctggggcaatcrttacyggtgcmgtggtgagcctatgcttcag

SEQ ID NO: 1002 - DNA, 401 bp, Artificial Sequence
  Consensus Reference Sequence
gtgggtattaggtyattcatttcattcttcacaactgtcattccacctttcttggggtccacttgtaccggactgacccaaccgctatcagagatagggtatacgagtccagcctctaacaacttaagcacttccttccttacttcttctttcatagttggattyagacgtctttgaggttgtcgaataggcttgtaatcgtcctccatcattattttatgcatgcagtatgaaggactgattcccttcaagtcagatatatgccatccgattgcttccttatgcctcctcaggatgtccaccatcttgttctcttcgtcctrtgttagtgcattactaattactayaggcttggtgtcaccctccaggaacacatactttaaatgattaggcaatacctt

SEQ ID NO: 1003 - DNA, 401 bp, Artificial Sequence
  Consensus Reference Sequence
atgcagtatgaaggactgattcccttcaagtcagatatatgccatccgattgcttccttatgcctcctcaggatgtccaccatcttgttctcttcgtcctrtgttagtgcattactaattactayaggcttggtgtcaccctccaggaacacatactttaaatgattaggcaatacctttaattcgaccttctttttttcgggcagagcctcattstctaatatctcaaaacaggcttccttctcagggatgacttcttgccgatccaagtcttccaagaaagcctttagatcctcttcttcttcactggtgagacagtccatcttatttatcattsctttctccagtgaagtgtatggtggttccagaatattgacattatcttccttgtcaatctcttc

SEQ ID NO: 1004 - DNA, 401 bp, Artificial Sequence
  Consensus Reference Sequence
ctgattcccttcaagtcagatatatgccatccgattgcttccttatgcctcctcaggatgtccaccatcttgttctcttcgtcctrtgttagtgcattactaattactayaggcttggtgtcaccctccaggaacacatactttaaatgattaggcaatacctttaattcgaccttctttttttcsggcagagcctcattgtctaatatctcaaaacaggcttccttctcagggatgacttcttgccgatccaagtcttccaagaaagcctttagatcctcttcttcttcactggtgagacagtccatcttatttatcattsctttctccagtgaagtgtatggtggttccagaatattgacattatcttccttgtcaatctcttctatcttgaagcactt

SEQ ID NO: 1005 - DNA, 401 bp, Artificial Sequence
  Consensus Reference Sequence
  misc_feature 263: n = A,T,C or G
tatttatcattsctttctccagtgaagtgtatggtggttccagaatattgacattatcttccttgtcaatctcttctatcttgaagcacttccaaccttcccgcrgatacttcattgctttaaagaggtcgaaagttatcttctrattttcaatactcagttccaagcttccgttccccatatctgcgacacagttggcagtcaacatgaagggtctgcctaagataaggggaatctctgtgtcttcattgatrtccatgatnacaaagtccamtggaaaagtgaagtggygaaccttgactaggacatcttctaccaccccgtatggtctcgtaattgagcggtctgccaattgaagtgtcatcttagtggratcaattttyagattcccaatttgtcta

SEQ ID NO: 1006 - DNA, 401 bp, Artificial Sequence
  Consensus Reference Sequence
tagccctttcatgggctagctgacccagttgtgtctccaggtttctgatagttgcatctgtgctctttgggtgtgatctcgtctcctggatgaatgcctttgtctcctgagtgcttgcccttgtttcttggatgaatgcctttgtctcytgagtgcttgcccttgtttcttggatgaaacttaagagcatttcctttatagtgagagacggcttctcttgctgactcagaccttgactagggtgctggtacgatggttgaggcctaggctccttgtactgatttccttgatttctccagtcggagccttggttaaagtttcttccctggttaaatgytggtggtccgttattgtatccaaaygggtttccttggttgtagccttggaaaccgtggcgatta

SEQ ID NO: 1007 - DNA, 401 bp, Artificial Sequence
  Consensus Reference Sequence
tgcctttgtctcytgagtgcttgcccttgtttcttggatgaaacttaagagcatttcctttatastgagagacggcttctcttgctgactcagaccttgactagggtgctggtacgatggttgaggcctaggctccttgtactgatttccttgatttctccagtcggagccttggttaaagtttcttccctggttaaatgttggtggtccgttattgtatccaaaygggtttccttggttgtagccttggaaaccgtggcgattaggattgcccatgtaawttatttcttragagggmtcatgttggrttgtgcattgtccagrctcatgtgtccctccacatgtgggacatccctctacttrcaaaacaggrgaatgagaartattcaytgcttryartt

SEQ ID NO: 1008 - DNA, 401 bp, Artificial Sequence
  Consensus Reference Sequence
  misc_feature 398: n = A,T,C or G
tttttyakaaatttctcwacaacttcttcccaagtcctaaarktgttgcccttaaaagaatgcaaccatctttttgcctctcyygctaaygagaaagaaaagaggttgaggcgtaccgcttgtgctggaactcyygctatcttaaycgtgttgcatatttctataaatraggctagatgcgtatagggatcctcacttgggagaccmtggaagaggttcccctgaatcagctgaatgagagaatgagggtaygaaatattargcgcttgaacctccggcggtgtgatacttgtgaagaattcwggagtagtagtatgrgagaartcytctaatgtaaccctaygtrctggttctycgtccatttgarcgtgatttggagaaagaggaggtgaagtatntat

SEQ ID NO: 1009 - DNA, 401 bp, Artificial Sequence
  Consensus Reference Sequence
  misc_feature 3: n = A,T,C or G
atntatgtcttgctccctttgtcttcttgyrgcgttgttacgccracadgtagcttcgatttctaagtctatrggaacgatartagatttayctcgcataaaaacacarggttctacccgtgtaatttatggaraaggaamgaatggggaaagaggagtggtgatagaaagaatggccaagagggaaacaaattacaaactggtagtatggcacttaaatgcgaaaacaaaatccccggcaacggcgccaaaaacttgttagctctttggcaagtgtaccaaatcgctcrtagtaataatttctcggtaagccgagtgtcrtaccacagggattttgttgcacttatgtaaagtacttttcagtttgcaaattgtaaatttagtgtataaaattaaaggca

SEQ ID NO: 1010 - DNA, 401 bp, Artificial Sequence
  Consensus Reference Sequence
tayctcgcataaaaacacarggttctacccgtgtaatttatggaraaggaamgaatggggaaagaggagtggtgatagaaagaatggccaagagggaaacaaattacaaacyggtagtatggcacttaaatgcgaaaacaaaatccccggcaacggcgccaaaaacttgttagctctttggcaagtgtaccaaatcgctcgtagtaataatttctcggtaagccgagtgtcrtaccacagggattttgttgcacttatgtaaagtacttttcagtttgcaaattgtaaatttagtgtataaaattaaaggcaatttaaatctacgtagctacttctaaactaaagaaaactaaagcaataaataaagaataaagtctataaaatattactaaaatctaata

SEQ ID NO: 1011 - DNA, 401 bp, Artificial Sequence
  Consensus Reference Sequence
  misc_feature 162: n = A,T,C or G
ggataaataagaaagaacggtaaataaaagaacctggaaggaaatcctctttttattgataactcttgaaatgctcyatacatmattgrytttttaggcctgycaggycctarctaggggtttagccactcatagtcatgagggctttacaatgagaagggnggggggggtgaaagaaaggtaataagaatataagaaaagggaaggaaatggagagaactgagtgccaaaagtctaaaaacagagctctgaggaagtgtgttcgttttcctaggctaaccttattatttataggtgcaaaattgggctttgggtcttcgtagtcccgctgagcgcgaagcctcgcgctcagcgccacctcgcgctcagcgcgtgtcgtgcgcttagcgccttgccttctt

SEQ ID NO: 1012 - DNA, 401 bp, Artificial Sequence
  Consensus Reference Sequence
ctaggctaaccttattatttataggtgcaaaattgggctttgggtcttcgtagtcccgctgagcgcgaagcctcgcgctcagcgccacctcgcgctcagcgcgtgtcgtgcgcttagcgccttgccttcttgcgcgctgggcgcgtcctgcgcttagcgccttgctgracttgrgcttcttctgattttcttcttttttttctttatttytgctcctttttgcttgttgtacctccctttttcacatctgmaatcaaaattcaaaattaattaaatctttccaaattaaagcataaataactgctaaataattaattctaagttaatttcagaccgattttycactattaattcactattatttagcagttatcaacgtccttctctatcataagccatca

SEQ ID NO: 1013 - DNA, 401 bp, Artificial Sequence
  Consensus Reference Sequence
cgcgtcctgcgcttagcgccttgctgracttgrgcttcttctgattttcttctttttttyctttatttytgctcctttttgcttgttgtacctccctttttcacatctgmaatcaaaattcaaaattaattaaatctttccaaattaaagcataaataactgctaaataattaattctaagttaatttcagaccgatttttcactattaattcactattatttagcagttatcaacgtccttctctatcataagccatcatccatttttcctttgaaatgcgatcaatycatgttgctatggctggactcagttgacgaaatttttctaaattttgataaaaaaatgtgcttgcaaggagtgtaggctgcataaaattagttatgaataactattttaagy

SEQ ID NO: 1014 - DNA, 401 bp, Artificial Sequence
  Consensus Reference Sequence
tttgtatgacaccttgtaygcaaattsactgttaatcctctcttgaatcaahgaaayttttattgatggatcttctctgrtcatgymtgtcaatagaataacaaaatttaaatgacaattaaggctaaacaataacataatatgaacataaaatacgtacctactacacaagtgacaattaaatvtgaatcaagcttctygtgatcttgggtcatggtcatattgagacatgtgtgtggtccaccccattsagtgactttccatgaatcagtttttttagatagaattdccctcatatagaaagggmaaggacaatctgcatttttattcaagcaacaaacvacatacttgtcccatttgctttcaaccactttgaaactttgatgmaycttcatarcata

SEQ ID NO: 1015 - DNA, 401 bp, Artificial Sequence
  Consensus Reference Sequence
gtctgtatcaratataccgtcaacactgtcatcttcgtctaaaraytyttcaacgtatgagttagacacaagataatcatcatcatcatcwtygtcaacatgtaaattgctcatatttgttggcrrttgtrtctcatcattagataaataatttccacatgatgtaagsgaatttgmagaatgaaacattgaaccactrgtcacatccttttctatgtacaattctagaactgacatttgttsttgttgtttaaaactttycagcatcgtttcaacgtcttygtcatcacaaatttrcaaggcaatatattttcctgacactaaaaatctacaactratagcagaaataatttcattattttgtaactttaccttrtctccaatttttttcttcaaagcay

SEQ ID NO: 1016 - DNA, 401 bp, Artificial Sequence
  Consensus Reference Sequence
catataaaatataaaactaatttaattaaaaaattattaaaaactatacattcaaactgctctaaaaaattacttaaaaatattttataatacaaattatttgactgaaaattaccaacctgattcagaaatttaagcctcaacaaacaaatttcaaaccttatgtgcacaaatttaaatctcaagaaacgttcacagtgtttgaaaactgaaatgtaattttgaacacatagcaacacttctgagaactaaaatgtagttttgaacacacaacaacactgaggtaatttttgagtatataagggccctaaatcgccatcttcaatggctatttccttcgccctaaatcgccaatggcaattgcaacttgcccttaactcgtcaatggcagtwgcaacttg

SEQ ID NO: 1017 - DNA, 401 bp, Artificial Sequence
  Consensus Reference Sequence
tcacagtgwttgaaaactgaaatgtaattttgaacacatagcaacacttctgagaactaaaatgtagttttgaacacacaacaacactgaggtaatttttgagtatataagggccctaaatcgccatcttcaatggctatttccttcgccctaaatcgccaatggcaattgcaacttgcccttaactcgtcaatggcagttgcaacttgccttttggcctgtcatctgaaaaaagcaacctgccacctgaaaaagcaagtgccacaggcctacgaacacagcacctggaactygccagtttgactggcggttcccactggcacgtatatcgccattagcactggcgatttcttcacggagaccaaactcaccagttccactggcggtttgggtgctacatg

SEQ ID NO: 1018 - DNA, 401 bp, Artificial Sequence
  Consensus Reference Sequence
taatttttgagtatataagggccctaaatcgccatcttcaatggctatttccttcgccctaaatcgccaatggcaattgcaacttgcccttaactcgtcaatggcagtwgcaacttgccttttggcctgtcatctgaaaaaagcaacctgccacctgaaaaagcaagtgccacaggcctacgaacacagcacctggaacttgccagtttgactggcggttcccactggcacgtatatcgccattagcactggcgatttcttcacggagaccaaactcaccagttccactggcggtttgggtgctacatgcatgcgttttacgtccaaaagagtcccctcgtggaaatacttcaaaaacgaccccatctggggaaaaagtttataaaaggaccccaaatggg

SEQ ID NO: 1019 - DNA, 401 bp, Artificial Sequence
  Consensus Reference Sequence
tataaaaggaccccaaatggggaaatttgcctaacttagagatagaatgcaaggcttgtattattcactgtcctatatatttatttaccaaacattggtggaaattttaaggagtgmcaagttcatattagcttttaaccatcaaagaaaaggctggcactaacaaccagttatttgtcaataggaaaggaagcttgggctcaattgaaggatattgtggaaaattagtgtctctttgatttcagaagctttactcttytttttttttcaatacttacaaaactatcatcttatttttttacctcatgtcatgatttgaagaatgtgttttgctacaaagtastgatactttaatttgcttcatgcatctatatmtrataccaatatattgatacatttca

SEQ ID NO: 1020 - DNA, 401 bp, Artificial Sequence
  Consensus Reference Sequence
ttgtcaataggaaaggaagcttgggcycaattgaaggatattgtggaaaattagtgtctctttgatttcagaagctttactcttytttttttttcaatacttacaaaactatcatcttatttttttacctcatgtcatgatttgaagaatgtgttttgctacaaagtastgatactttaatttgcttcatgcatctatatctrataccaatatattgatacatttcattggtacatatatgtgaagtgaccaattctttaaaaaaattatgataatcaaatatadtgacatgtaacawagaagtaagtataatatagaaatataaaawdtattrtttcttgatgaaccaaatatgaaaattgttttgtttatagataatttcaaraaagaaatgagattga

SEQ ID NO: 1021 - DNA, 401 bp, Artificial Sequence
  Consensus Reference Sequence
catyatccttgcctccaaygcttcaycactttgggaaacattctccaasttccyaatttcaagctgaccatraagatttgaaagtcctcccaattctttgatcccattctcttkgtgcttrcccacaacaaagaaatccagatgttgtagrtgatttaatttacwmattyctctcggcatctcttytataggagtttcacgtatctcaagatgacgcaagttaacaacattgcrcatgtcactaggcaacttagtcagytttctgcaacwacacaacttcaaagtttgcagattgtataaattacacaatgactttggcagtgtttctacacttgaatgagaragatctaaatagcgcaratgratcaatttacctattgaatcaggcaaagaatccagac

SEQ ID NO: 1022 - DNA, 401 bp, Artificial Sequence
  Consensus Reference Sequence
cactgcrctctctttcaaatyaagaytctccttgagttttaaatgagactcaagcgtgacaactatgtcttccaacttactaacgatcttcctattggaaaagcgagaaatcaagtctcttaccttgttttgggtggcagctttggtgaaaacatggtcgagtaagtcatcggcttcatagacagcatctttgaragcattgagccagtgtttgacattggtgtttgtgrtctgtttcttctcggcatcatcaagcacagctccaaccactctgagartggtctccaacttttgaagcaacttcttgcyaagcttctttccamggatcaagtsaacaaactcaggtgaagccagcctgtcgaaaagcacatcaagraaagcagagagaaaggcaccaccka

SEQ ID NO: 1023 - DNA, 401 bp, Artificial Sequence
  Consensus Reference Sequence
atccaaaagtkatgtaaagatgctcaayttagaatttytttctaaagttaaaatttaaaatcaattwttcaatgtgaaagtaaatagtcaaatatttacwtaaattcgtgttagtttatatttcaacctgattttttataatcaaacatagatcattaaagttgtcatagagatatgttattgtataaagatctaatactgaatcatgattttataaaaagttaaaataattgatagtaatttatakttttttaatcaagtggtaaaagatttaaatctttattaattcttatatatagaataaattttgttaggaggaaaataaaaaatgagattaaaaaattattaagacaawaaaaatgttgaacaaatcaaaagagaaaattaaagaaatgacacat

SEQ ID NO: 1024 - DNA, 401 bp, Artificial Sequence
  Consensus Reference Sequence
attatttttttcwttttactaccaaacaaaaccttacaggatttttttactccactacacttgctctctcctcattttttccaaaatacacctgcctcaaaatygtttcctaaacaacactccyttttagcttgcagagagaagtcsgggttagggaacccaacttctctttgctcctattattttttaattttaaaaaattattaaattcttttttatattttttaaaaataatttacttgttttttaaattttattttcagataaaaaaataattaaaatttttaatattattattttgttttttaaataatgagaatattttttgtttaattatttattwatagtttgaaaataattaattaataatmttaaaataaatttaaaaaamaaagtgatta

SEQ ID NO: 1025 - DNA, 401 bp, Artificial Sequence
  Consensus Reference Sequence
  misc_feature 11: n = A,T,C or G
gtagaaatcantataaatacaatagcatgtaataagcagcacratatgaatgaaattagcaaattactcycatctctgctcttcttcttcctctrgaggttytggtgcctcgaagccagytcttaatttcytgcatttatgttcagttcgtaacaattggtkctctcgtttgtcctcatggcctcmcgcaacctcgacgaggcccttgtccgtcttgacaataccatgcactctatgaccctcaayatggacaagcttckcaaccgccttgctcctgtgccttcctccwccacgcccaaccccacacyagtccctygccactccacctctgttcctrcacaaatccgatatgccycatcaccgtatgaggatcctgtcgrtgccttgttcaaactcactca

SEQ ID NO: 1026 - DNA, 401 bp, Artificial Sequence
  Consensus Reference Sequence
ataaaagatttaaattaaaagatggtaaagataaaaaagataagatwagaaaaataaaagataacagaaataaaagattaagataaaaaagataagtgttaacatgctaaaaattttcctttttgatattttctcgatctttttttttaatctatcattttcatatttgcaagccataaataataaaattatcaattcttgtyatttaagctaaaaataattgttaaataaatatttttaaagatatttcaatatatttttattataaaaaatagytyacatcatatttaacactctttcccttacaaggaaaataaaacgcgactcatactcacgcagtcacgcgacacaccacagtgacacarcctcggcccaccaccatgycaccacgcaaaatacat

SEQ ID NO: 1027 - DNA, 401 bp, Artificial Sequence
  Consensus Reference Sequence
tgaacttaatttgattgtattgtatttttattaaaattraaattcttttaaaactaggcccgtggaccggtccatttgacccgtggggtctgcgaggcaagggcggaccaatttatttggtccgtgtaagaagcggggcggactggtccggtccgctaccaatgcgggcgggccttacgcggggcggggcggcccgcttatccayccctaccgcagacccattgggtcctaatatagagcaacctgacccgaagctagccacactyatatccgaaggacctracccaaaacccacacctgacccagacccaaaacccacacctracccgracccaaaccccacacycgacctggaactggcccaaataagttcgaactccttatcgggtgatttagcaccg

SEQ ID NO: 1028 - DNA, 401 bp, Artificial Sequence
  Consensus Reference Sequence
cttaatttgattgtattgtatttttattaaaattraaattcttttaaaactaggcccgtggaccggtccatttgacccgtggggtctgcgaggcaagggcggaccaatttatttggtccgtgtaagaagcggggcggactggtccggtccgctaccaatgcgggcgggccttacgcggggcggggcggcccgcttayccatccctaccgcagacccattgggtcctaatatagagcaacctgacccgaagctagccacactyatatccgaaggacctracccaaaacccacacctgacccagacccaaaacccacacctracccgracccaaaccccacacycgacctggaactggcccaaataagttcgaactccttatcgggtgatttagcaccgagaa

SEQ ID NO: 1029 - DNA, 401 bp, Artificial Sequence
  Consensus Reference Sequence
cgtggggtctgcgaggcaagggcggaccaatttatttggtccgtgtaagaagcggggcggactggtccggtccgctaccaatgcgggcgggccttacgcggggcggggcggcccgcttayccayccctaccgcagacccattgggtcctaatatagagcaacctgacccgaagctagccacactyatatccgaaggacctgacccaaaacccacacctgacccagacccaaaacccacacctracccgracccaaaccccacacycgacctggaactggcccaaataagttcgaactccttatcgggtgatttagcaccgagaattttgcaccccgtcrgccttctctccggcaattgtgtggtcctccttgttgatgggggaagtaaccacaacttcctc

SEQ ID NO: 1030 - DNA, 401 bp, Artificial Sequence
  Consensus Reference Sequence
cacacycgacctggaactggcccaaataagttcgaactccttatcgggtgatttagcaccgagaattttgcaccccgtcrgccttctctccggcaattgtgtggtcctccttgttgatgggggaagtaaccacaacttcctccagcctcaactagctatctctttgggcttaccttgtcggaccgctccaacaccattacgcgtgatgttctttcatcacgggcgcttcgtggaattgcakggtgagaacgccaccactccgggtcttcttccccaacaccagttctgccacctctrtcggcacaaygagggtktttcgcacttccatattgctaggtttcctgaagctcctcctgactcactacccattgacacacctagtgcaattcgtcggaataaac

SEQ ID NO: 1031 - DNA, 401 bp, Artificial Sequence
  Consensus Reference Sequence
ctccttgttgatgggggaagtaaccacaacttcctccagcctcaactagctatctctttgggcttaccttgtcggaccgctccaacaccattacrcgtgatgttctttcatcacgggcgcttcgtggaattgcakggtgagaacgccaccactccgggtcttcttccccaacaccagttctgccacctctrtcggcacaatgagggtktttcgcacttccatattgctaggtttcctgaagctcctcctgactcactacccattgacacacctagtgcaattcgtcggaataaaccttgagatcccrgtattgtttttggatccatagtttgaaaaaccaacaccttgaggacaaggtgtttttgatggggcagggagtgatagggaagcgtgatagcata

SEQ ID NO: 1032 - DNA, 401 bp, Artificial Sequence
  Consensus Reference Sequence
gcacttccatattgctaggtttcctgaagctcctcctgactcactacccattgacacacctagtgcaattcgtcggaataaaccttgagatcccrgtattgtttttggatccatagtttgaaaaaccaacaccttgaggacaaggtgtttttgatggggcagggagtgatagggaagcgtgatagcatagcagacaaagggatgtattcaaaagaaatagatgcgaatcaagacatagcaactataggggtgtctacagcaaagaagggtgtaaatcaagcagaaaagraggtgcaagcagcagtcaatacctaaagaaagacctcaaagcctgcttaccttaaggactacgtgtgatcctaaggarygatgttgaatgatctgtgctggaagcatgggag

SEQ ID NO: 1033 - DNA, 401 bp, Artificial Sequence
  Consensus Reference Sequence
gatcccrgtattgtttttggatccatagtttgaaaaaccaacaccttgaggacaaggtgtttttgatggggcagggagtgatagggaagcgtgatagcatagcagacaaaggratgtattcaaaagaaatagatgcgaatcaagacatagcaactataggggtgtctacagcaaagaagggtgtaaatcaagcagaaaaggaggtgcaagcagcagtcaatacctaaagaaagacctcaaagcctgcttaccttaaggactacgtgtgatcctaaggarygatgttgaatgatctgtgctggaagcatgggagacaagaaaaatgatttctgatttcctctagcacaaaaggacaaaatcwgttatgtagaaatcagtataaatacaatagcatgtaataa

SEQ ID NO: 1034 - DNA, 401 bp, Artificial Sequence
  Consensus Reference Sequence
  misc_feature 229, 337: n = A,T,C or G
aaacagcttctatcttcttccctatcaacaagtatatagcatatataattatgtatgacaattttaagaaaataaasaacactaatataaaatatatagaatggtaaaatacaaaaaaaaaaaaacaaaaaaaacaagatcatayctgcatttcgagwggtatcttatggaatctagattacccaagaacagaaattaaacacttgaaagaagaaacagagwaaaaagnaaaatatttaagatatgttgtaacccggaatcaaaataaaagtttataaataattcaagcacatatatatacaccaaataataataccttagtaaargcaaaaaaaanataataataccttarcaaattttcctctgaaaacagagagtgcaaccttccasaaggctcgtgt

SEQ ID NO: 1035 - DNA, 401 bp, Artificial Sequence
  Consensus Reference Sequence
  misc_feature 104, 212: n = A,T,C or G
caaaaaaaacaagatcatayctgcatttcgagwggtatcttatggaatctagattacccaagaacagaaattaaamacttgaaagaagaaacagagwaaaaagnaaaatatttaagatatgttgtaacccggaatcaaaataaaagtttataaataattcaagcacatatatatacaccaaataataataccttagtaaaggcaaaaaaaanataataataccttarcaaattttcctctgaaaacagagagtgcaaccttccasaaggctcgtgtgtaatgcatgattacwgcagtaaaacaatttccactgttttctcttctatgtkatttagaacaccrcaatgtcatgtaaaaaattgacaagaacccatataacaggtgctcawgygtgtgaacca

SEQ ID NO: 1036 - DNA, 401 bp, Artificial Sequence
  Consensus Reference Sequence
aacaaatwaaaaaattactatccataacatctatttcgatgaactatcgcatagctaatctatttgttcggggtcttgaagttaaagcttggaggacaaaacaaagtagtgtacaagtacttggtgctatggcataccgtgctcctcarcatttgtctcrgtgtctccytaagattgttcccaaattgrctgaggtataatatgaagcaaacattatttttcacttctaaattccttttaagctatagattgcattacyttaacccatctcrgtatttgaaggttttsaytgatacacatcytawagtccagtcagctgggcaaatggcccttcaacacgttagtcttgactyacgaactattctatccatttgattcmtgcttgcttctgtgattaatgt

SEQ ID NO: 1037 - DNA, 401 bp, Artificial Sequence
  Consensus Reference Sequence
ttgtctcrgtgtctccytaagattgttcccaaattgrctgaggtataayatgaagcaaacattatttttcacttctaaattccttttaagctatagattgcattacyttaacccatctcrgtatttgaaggttttsaytgatacacatcytawagtccagtcagctgggcaaatggcccttcaacacgttagtcttgacttacgaactattctatccatttgattcmtgcttgcttctgtgattaatgtttttaattttcatgttttttccaggtagggaatgtgatagagtccagaaatatctggtcttrtccctactctacttaagtaaattggtgttttcrgtatctagagggaggaataaaagtaattcttttgaaattrtggcataaraaatcrtc

SEQ ID NO: 1038 - DNA, 401 bp, Artificial Sequence
  Consensus Reference Sequence
  misc_feature 396: n = A,T,C or G
acccatctcrgtatttgaaggttttsaytgatacacatcytawagtccagtcagctgggcaaatggcccttcaacacgttagtcttgactyacgaactattctatccatttgattcmtgcttgcttctgtgattaatgtttttaattttcatgttttttccaggtagggaatgtgatagagtccagaaatatctggtcttgtccctactctacttaagtaaattggtgttttcrgtatctagagggaggaataaaagtaattcttttgaaattrtggcataaraaatcrtcattcaattcmactctactwttatatgttgcatatttattgtaattrtttgatgtatattttcatgaaatttcatycttcaaatcttatctatacaaaaatgttantgtta

SEQ ID NO: 1039 - DNA, 401 bp, Artificial Sequence
  Consensus Reference Sequence
ttcagataatatccaaacgattcaactttattttaaatacactartcacttatactcrgtcacttaatcatttggttgcatcaratttartttcactctargcaataacatgttggtcacaagaatatatattacatattaactttgaaaataaaatataataaaatttctaactcaactttttaawtttcttarttttctttctaatartatggtcactcatcaaagcatggcttgggtatatactatatagcgaagatcctccgtcatcttgaggatatatatwtcatgatcataagtggaataagaatgcacatattgcaawgatagaaatttawkaaagacagtgcatctgaaaarcagatggattatcattgatatgcatagtagttggmcaataa

SEQ ID NO: 1040 - DNA, 401 bp, Artificial Sequence
  Consensus Reference Sequence
  misc_feature 335: n = A,T,C or G
aatgagctattkaacracgcacatctatcrgggactgttttagaatgtttctgggtggtaattttgtaattagagacaaaaacaacgacaattttctgtgataattgttgttttaattcctcttagtaatgacattgagaatacttataagctggaagtggtacgraaaaatacttgttgtaatcaagtttgattagtgagatcctttactggttagtaaaggagaactagacgtaactcaggttaagtgacccgrtataaattggagtatttttactgttttttttttaatttatcaaagtatttcaaagtcaattattgataatttagcacanaaagttttcagtgaaaaataagttttatatatcattggacgamaatccattttttgtcactggccg

SEQ ID NO: 1041 - DNA, 401 bp, Artificial Sequence
  Consensus Reference Sequence
  misc_feature 280: n = A,T,C or G
tggtaattttgtaattagagacaaaaacaacgacaattttctgtgataattgttgttttaattcctcttagtaatgacattgagaatacttataagctggaagtggtacgraaaaatacttgttgtaatcaagtttgattagtgaratcctttactggttagtaaaggagaactagacgtaactcaggttaagtgacccggtataaattggagtatttttactgttttttttttaatttatcaaagtatttcaaagtcaattattgataatttagcacanaaagttttcagtgaaaaataagttttatatatcattggacgamaatccattttttgtcactggccgagggtttttataaacatcttycattttaaaaggttttatattttgattaacacac

SEQ ID NO: 1042 - DNA, 401 bp, Artificial Sequence
  Consensus Reference Sequence
  misc_feature 114: n = A,T,C or G
ggagaactagacgtaactcaggttaagtgacccgrtataaattggagtatttttactgttttttttttaatttatcaaagtatttcaaagtcaattattgataatttagcacanaaagttttcagtgaaaaataagttttatatatcattggacgamaatccattttttgtcactggccgagggtttttataaacatctttcattttaaaaggttttatattttgattaacacactatttcacccstttctagtgtgatgtattgtattccaattattttgattaattatatttgaaggaaatgttattaaaactcctttttgtaaatagttcatggaaccaatgattagtattttaattttcttktgccaataaatgcagtttctttagttggtttagtg

SEQ ID NO: 1043 - DNA, 401 bp, Artificial Sequence
  Consensus Reference Sequence
  misc_feature 69: n = A,T,C or G
agtatttttactgttttttttttaatttatcaaagtatttcaaagtcaattattgataatttagcacanaaagttttcagtgaaaaataagttttatatatcattggacgamaatccattttttgtcactggccgagggtttttataaacatcttycattttaaaaggttttatattttgattaacacactatttcacccgtttctagtgtgatgtattgtattccaattattttgattaattatatttgaaggaaatgttattaaaactcctttttgtaaatagttcatggaaccaatgattagtattttaattttcttktgccaataaatgcagtttctttagttggtttagtgaccgtgagcaaaaagatgatgtggatgaaattcatgacgaggtat

SEQ ID NO: 1044 - DNA, 401 bp, Artificial Sequence
  Consensus Reference Sequence
tgaactcattttyagatgtttgatgccaaaagaaaaaggatgagttacccagctaatattaactgcatgtctttggaacttgctcttgttgcaacgttagcatcattagyttatgatatttgaycatcattagcttagtcttttttatacttgagtatattgcttttggtctactracccaacaatcaaggtacgcatgttattagaatttggtttagacttttttaactgaatttggtcttccgtgttcamcaaggcccagtgtkgtgtttgtgttcttactttgtttgtttgggttcagttgtcttcaatcttcatagtactagaaaaaaagtcatgatcaccatcttataattaagtatttttttattttttataatatatttgtctaaattattttt

SEQ ID NO: 1045 - DNA, 401 bp, Artificial Sequence
  Consensus Reference Sequence
tgataaaagaaaatcttcaactactattgcattcggcagttgcatgtgcaattttaatgggggaccctcatttcccagtcactgtctatatctattmctaaaagacagctgaactgatatcgtaaatcattcctgtgcarggaataaatacaggagaaatgtaatgggttacccagaaattatataaatcagtttaatatcatattttaatttaaaatattaaarctcaagttttatggatattttttttatttatatggtgtttaatcwtcttatkcagactgaatgtgagacttgactttacatttatattccaacaatttctaatttttggactctgaagggaagcgtgtggcagtcaagtattactcagatgactggccaacaaacaatgcaaagtt

SEQ ID NO: 1046 - DNA, 401 bp, Artificial Sequence
  Consensus Reference Sequence
agtgaaaccctttaytggttaataaaggagaactagacgtaacwcaggttaagtgacccggtataaattggagtatttttacttttttcyttaatttatcaaagtatttcaaagtcaattagtgataatttagcacacaaaagttttcagtgaaaaataagttttatacatcatwggacgacaatccattttttgtcactggccgagggtttttataaacatcttccattttaaaaggttttatattttgattaatacactatttcaccccctttctagtgtgacgtattgtatttcaagaagataacaccaattaacgtcraccaaaaaaatccctaaataatgttagccaaaaaataactttggtcaatgccgaccaaacaatcctagccaacatcaac

SEQ ID NO: 1047 - DNA, 401 bp, Artificial Sequence
  Consensus Reference Sequence
gtgataatttagcacacaaaagttttcagtgaaaaataagttttatacatcatwggacgacaatccattttttgtcactrgccgagggtttttataaacatcttccattttaaaaggttttatattttgattaatacactatttcaccccctttctagtgtgacgtattgtatttcaagaagataacaccaattaacgtcgaccaaaaaaatccctaaataatgttagccaaaaaataactttggtcaatgccgaccaaacaatcctagccaacatcaaccaaaaatagycttagttgacttcaaccgaaaaaacttaaccaatgtcggccagaaaataacctygatagwcattaggcaaaaaataccctagttgacattgaccaaaagatagcatcgatc

SEQ ID NO: 1048 - DNA, 401 bp, Artificial Sequence
  Consensus Reference Sequence
ttttataaacatcttccattttaaaaggttttatattttgattaatacactatttcaccccctttctagtgtgacgtattgtatttcaagaagataacaccaattaacgtcraccaaaaaaatccctaaataatgttagccaaaaaataactttggtcaatgccgaccaaacaatcctagccaacatcaaccaaaaatagtcttagttgacttcaaccgaaaaaacttaaccaatgtcggccagaaaataacctygatagwcattaggcaaaaaataccctagttgacattgaccaaaagatagcatcgatcgaaaaaamttttgacaacatcgaccataaaaaagtcacaaccgtyaaccaaatataaacccktgacgacattaataaaaaaatagtctc

SEQ ID NO: 1049 - DNA, 401 bp, Artificial Sequence
  Consensus Reference Sequence
aaatccctaaataatgttagccaaaaaataactttggtcaatgccgaccaaacaatcctagccaacatcaaccaaaaatagycttagttgacttcaaccgaaaaaacttaaccaatgtcggccagaaaataacctygatagwcattaggcaaaaaataccctagttgacattgaccaaaagatagcatcgatcgaaaaaacttttgacaacatcgaccataaaaaagtcacaaccgtyaaccaaatataaacccktgacgacattaataaaaaaatagtctcgactgatgacaactaaaaaatatcatcacgtgatgttggtcgaaaaaactctgttmtaaatcagccaaaacatagccttkaccaaagtcgactaaaaaatccctacttagcatcatcca

SEQ ID NO: 1050 - DNA, 401 bp, Artificial Sequence
  Consensus Reference Sequence
atcakacatcctatacagagaaatataacaaaaattaattgtatattcacaaaaagagaacataaaaagtttcataatagagaacagaaggcaagtttcataatagagaagagaagagaagaagtttgagaataaaaagagaacacaagaggagaggtttgacgatagaggccagatggayratgaacaccatgaaaaacgcgatggcaacagtgtcgttatagtcatcgtcgaaaccccaaaaacaatcrtctgtcgacgaygaagayactagccaacgacartgtcattatgaccaaccaataaaagtcatatgcgtakaaaaaaatataaaaaagcatacaaaaacracayagcatatgataaagtccaaacctgggtgtgcgtcgttgtggtcacca

SEQ ID NO: 1051 - DNA, 401 bp, Artificial Sequence
  Consensus Reference Sequence
gaccyccaacactgagatgggtaagcatgcccatggatggccatgctaggccgctcagtagtttctcacaattgacaatcchaactgttctcaggttaggtggcatacccccttctgraaaysactcaatttctgggcagtwggatatgtaaagatgttctaactttgggagaagagtactcatctcatcaggcaacgacttcaacttgtcagagccccaaactttgaaagtaatcaagttgggcgcagacaatccttctctccagaatgatacaaagttggggcattbrtaaattctmaaagaabacagactcttaaatgactctgcccctgaaacmaaaagatattccatattttcacagtwtctgattgcaagatctctgagatttggaaaggtaacc

SEQ ID NO: 1052 - DNA, 401 bp, Artificial Sequence
  Consensus Reference Sequence
gaatggcgggagccgttgggagagaagagacaagcagctcgcaatcactaatataaagtgtttccagagccaagtattctaagacttttaagcaaaggaaaagcttctgaatcaaaggaactccacaactcccaacaaggcatgtcataaatgaacagagataaagggcctccaagaacgacaatcttcattcttgtaaagrcctgcatcgatagtcttcagcctattcaatcttgaaattacaaggaaccgwgagaaggtagctgttcaagtgaaggaagcatactacagttgtcacaatcacttaaggttagacgtgtcatattgcrgtaggaagaatttcccatccaatctggaaatctggttcctttatagccttttatttgcaamgattcaatgtt

SEQ ID NO: 1053 - DNA, 401 bp, Artificial Sequence
  Consensus Reference Sequence
aatggcgggagccgttgggagagaagagacaagcagctcgcaatcactaatataaagtgtttccagagccaagtattctaagacttttaagcaaaggaaaagcttctgaatcaaaggaactccacaactcccaacaaggcatgtcataaatgaacagagataaagggcctccaagaacgacaatcttcattcttgtaaargcctgcatcgatagtcttcagcctattcaatcttgaaattacaaggaaccgwgagaaggtagctgttcaagtgaaggaagcatactacagttgtcacaatcacttaaggttagacgtgtcatattgcrgtaggaagaatttcccatccaatctggaaatctggttcctttatagccttttatttgcaamgattcaatgtta

SEQ ID NO: 1054 - DNA, 401 bp, Artificial Sequence
  Consensus Reference Sequence
cgaaaccaaatcatcaaaatactcatgaccaacctcttctaaagtcctacctktgcwtgatttcttcaaaagrtcttcggccatccacaacaagaytaattcatatttttcaaattcgtaatcttgtggatacaaggaacaataaacaaagcaccgtttwaaatgtggagggagataatgataactaagtctcagtgctggaataacttcacactcactttcagaaagttcccaaatgycactattsagratattattccaatccacgatgtcatgctttcttctcaacatgcctccaagcgactgtgctgctaaaggcagtccgttgcactttttaacaatctcctttccaattttttctagtgttgttgtgttcycgtccgattccgaggaaagacacg

SEQ ID NO: 1055 - DNA, 401 bp, Artificial Sequence
  Consensus Reference Sequence
atgagactcaagtgtgacaactatgtcctccaacttactaccgatcttcckatyrgaaaagcgagaaaamaagtytcttaccttgttttgggtggcagctttggtgaaaacatggtcgagtaagtcatcrgcttcatagacagcatctttgagatcattgagccagtgtttgacattggtgtttgygrtctgtttcttcttggcatcatcaagcacagctccaaccactctsagartggtctccaacttttgaagcaacttcttgctaagcttctttccaaggatcaagtsaacaaactcaggtgaasccagcctgtcgaaaagcacatcaaggaaagcwgagagaaaggcaccacctaccactgctkctgccatyatctcaagaacaaaagatgatcaga

SEQ ID NO: 1056 - DNA, 401 bp, Artificial Sequence
  Consensus Reference Sequence
gataaggttttttttatttattatttgtwttattatggtggtgggtgacttatgacttatgactagtttcatttctgttwccaaaccgtgtggagcagtggtgtatgtttttttctttcatttctgaawwtgyttgyaggtttcayaaaacactgatcccttttctwtgtgatwtgtatggatggctgcaagggtactgygcgtatttaagttcctgtctttaatggtctgtaagacaagttgtrttaaggcagattgtacatgtgtttgtatgaacggtacaamagttgattycacaaatctaatttatatttggatatttttattccaaaaataagttagtagtaaaattgaaaataattttttttgtgtaatccawaagttatctaaaaatacttaac

SEQ ID NO: 1057 - DNA, 401 bp, Artificial Sequence
  Consensus Reference Sequence
  misc_feature 64, 82: n = A,T,C or G
gttttgatgtcttattattatcaattgttatattggattatgaagtatggatgrattttttttnctcaaataatgttagttntatatacttatatatagatraatatataattttaaatttttataatatatcargtcaaaccagtccratgactggtccaacaccaytgacccactcaccaactattttgatttggtcagtgatcgaactgagtttmacaactatagttgcaagtataacattacaataaacacttaaaaaatagaaaaayaaaacttwgttawaacaaacataatgataaacataatattgatttaaaagcttattattrtgtttattctaagttatgtktgattttctrtttttttaaagtatttattataatgttatatttacaaca

SEQ ID NO: 1058 - DNA, 401 bp, Artificial Sequence
  Consensus Reference Sequence
tttttattgaaattaagaatwtttttatyatgaaaatctcccttattaaatgtaacaaattaaatattttactctatyatttttataaatactagtcaatgcttwaakaacatttaataaaaaaaattattattttgaatacataaagataaagaatataccatactataatatttggtctttaaaattattaaacacattcttgagacaacatttttatatgctaacaatgtgggyttgagaawcagcttagaagttagaactagaaggtgttagaatattctctaatgctctyatttattaaacttgacakcaacttctgycttttcttcctccttcttagttataacgcctytatgatcatcattcctctcattgcaccataaagcaaagaacacaaa

SEQ ID NO: 1059 - DNA, 401 bp, Artificial Sequence
  Consensus Reference Sequence
ttgtgggttttaaagtgattttttctttctaarttgtctcyttttctctttgtttgtttcatgagaaacatccgtcatcwtggtgtaggggatttaaattttatgcttctgagttatttgtartctattagcgtgtttgatttcacatcatcgacgtgatcattmtctgggaatgtgatttcatgaagctactagttatatcttctacatatctcagayawgattttttatttctcaaactgatttccaacacgctatatatttcatgtgaaagaaaagacacataaattaytataaaatgtgtaatgtttgttaaacttggtttttgtgtagcatgagaagatctaagtgcrcgttcggtcaatttttaaaaataataacatttttaaaaataaacagta

SEQ ID NO: 1060 - DNA, 401 bp, Artificial Sequence
  Consensus Reference Sequence
ttttctttctaarttgtctcyttttctctttgtttgtttcatgagaaacatccgtcatcwtggtgtaggggatttaaattttatgcttctgagttatttgtartctattagcgtgtttgatttcacatcatcgacgtgatcattmtctgggaatgtgatttcatgaagctactagttatakcttctacatatctcagayatgattttttatttctcaaactgatttccaacacgctatatatttcatgtgaaagaaaagacacataaattaytataaaatgtgtaatgtttgttaaacttggtttttgtgtagcatgagaagatctaagtgcrcgttcggtcaatttttaaaaataataacatttttaaaaataaacagtaaaaaattatgatattttaaa

SEQ ID NO: 1061 - DNA, 401 bp, Artificial Sequence
  Consensus Reference Sequence
ataaattaytataaaatgtgtaatgtttgttaaacttggtttttgtgtagcatgagaagatctaagtgcrcgttcggtcaatttttaaaaataataacatttttaaaaataaacagtaaaaaattatgatattttaaaaccaaattctggtataggtggatggttgttgttttcatgagttaagctctctcttggtgagaggggtgtttgtgtttatttgcctttttctcttaacrgcaaatttgtaaattttttcctttttttttcatctggaaaattttaatttattgccaatatgtattgaaaataacttagtacatgtgacccaagcatgaaaatttgtagatagacggccaaagttaggtarcsattgtaatgsaaagtggaaccacatgcatctg

SEQ ID NO: 1062 - DNA, 401 bp, Artificial Sequence
  Consensus Reference Sequence
ttgttttcatgagttaagctctctcttggtgagargggtgtttgtgtttatttgcctttttctcttaacrgcaaatttgtaaattttttcctttttttttcatctggaaaattttaatttattgccaatatgtattgaaaataacttagtacatgtgacccaagcatgaaaatttgtagatagacggccaaagttaggtagcsattgtaatgsaaagtggaaccacatgcatctgaaaaaaggtgccaactcagttatatttwtacttgcctatttgaaacyttactgaattttcgttttcttctcgagtktcattaaactctcccaactttagaagattaatttgggcagatgagtgtgaatgacttgatttgtctwtgtaattcaaaacagaatgcagg

SEQ ID NO: 1063 - DNA, 401 bp, Artificial Sequence
  Consensus Reference Sequence
tattagtgtgctttctgccatctgcygrttgattgtttgattaaattttatttcttctgcgtaatgtgtggccatatttggtttccatttattcttgatttttgacaatcttacatttctgycatacttgtttagtcttsttttgttcttcttggtcatgaatygtttatttttaagaactctaaaaaccagtagactacttgagagaaatgtaattgatgtgctaaatactttgttttttaatcyagtcctgtttaaatatgatcaaaactcacctaatgycttatggttttgggattgttaaagtaaatagtcaaatagtcaaatatttacttaaattcgtgttagtttatatttcaaccggattttttataatcaaatatgaaatcaaacacaratca

SEQ ID NO: 1064 - DNA, 401 bp, Artificial Sequence
  Consensus Reference Sequence
ttaattaataatcttaaaataaatttwaaaaacaaagtgattwaaaaaatagattgattaaaaacmcaataaatatatgattatcacatcttaattatattatattaagaaattaaaatactcaaataacataaaataytaaaaattaaagagacaaacatcataaatggaacatataataaarcaaaaatarcagaatggactaacaataataattgaaacatgaaaataatgaaagcataaatmactaacacatgaatcattcccattaccaacctcatttgattattaatccttggtaaggaggcatgttacaacckattatagttttttaccaaacaactwcggtattcatactagaaaaaaaatgtgaaaattttcgataataaagacataacaga

SEQ ID NO: 1065 - DNA, 401 bp, Artificial Sequence
  Consensus Reference Sequence
tctaacttattttttctcctcacaattatttttatcttttgtactaccaaacaaaaccttacaagagtacttgsttagtaggggtgrgaatakgtcargtcggcctacaggggcstatgacctggcctacataaagtctgacctatttaattaaaaggttaggctaagacttttttaaaagcctattagattaaatagactaggcttagrcttattaaaaaaccttataaacctgataggccggcctatatatatatatatatatatatatatatatatatatatatatatatatatatatatatatatatatatatatatatatgatgtctcacaaagggaacgaggactcctttaaatagacccaagattttactgtatctacagtatcggtaatgttt

SEQ ID NO: 1066 - DNA, 401 bp, Artificial Sequence
  Consensus Reference Sequence
tgycagaatacattggtccaggcgtcaatgtaatcccaataattatatcctrcagggtcaaaaggtgcagaaaatttcttgggttggttcaagttggagycataatgtcrtggctgcattacttttakgatctggattgtggagtgggtgtttrgatttgggtctttggggtccttgaaatgtttaatagatacggagtttgtatctattaggatgaattcatagaattttctggttttgtttatggytrttggcctataatgaaatcctggggggaatactttggcggtggccttgaaaggattcttatcccagtattytggttccatttgtaagacattgaaraatttgttttttgaaatgtagctgttgttgggttgtgatgttgagtcttgttgagt

SEQ ID NO: 1067 - DNA, 401 bp, Artificial Sequence
  Consensus Reference Sequence
tacttttakgatctggattgtggagtgggtgtttrgatttgggtctttggggtccttgaaatgtttaatagatacggagttygtatctattaggatgaattcatagaattttctggttttgtttatggytrttggcctataatgaaatcctggggggaatactttggcggtggccttgaaaggattcttatcccagtattttggttccatttgtaagacattgaaraatttgttttttgaaatgtagctgttgttgggttgtgatgttgagtcttgttgagtcaacggttggctttgtttttkgttacagatggttttggtctgtttggctttttgaatttgtttttgcagatccattttagaatcatcgtctgattctgaggccatttctrcccaggtcy

SEQ ID NO: 1068 - DNA, 401 bp, Artificial Sequence
  Consensus Reference Sequence
accttaggaggcatcgggaattttctgtaaaaattcacgggtgaggtagtcaggtagagagtttgaagagcccttgatatactctatgtcaaaatcaaagacgcttaaaattgcttgycatcttgcaaaaatttgttttgagacaaggcttttaacatccatttgtaaaatgtctttggctgatttgcagccaaccctaagtaaaaatttttgattcaataaatcakattgaaatttggaaatgcacaaaacaattgctaaaacttcttttttaacrgttgaatattttaattgtgcaggattccaatgttttgaagtatatgcaaygacatgctcttgaccatgtacttgctgtttgaggatgccaccataaycgatgtctgatgcatcagtttcracaa

SEQ ID NO: 1069 - DNA, 401 bp, Artificial Sequence
  Consensus Reference Sequence
ycggcaaactctattgatctttctattggaatgattgtaccttggtatatawtgtgaccaaggaatcgtattcgtgtctggaaaagattgatttttkatttggagactgccaaaccattctgtttaatgatatggatgaaagtctgaaggtgtttgaaatgttgatcaatatcttgggaaaagattaaaacatcatcaatgtagacratgacgaattttgaataaggattgaaaatatcattcataatttttkgaaattctgaaggggcattcttcagtccgaatggcattacattccwctcatattgcccgaaaggtacagtaaacgccgttttgtacctgtctgattcttggatttggatttgccaaaatccagatttcatatcaaattttgaaaatac

SEQ ID NO: 1070 - DNA, 401 bp, Artificial Sequence
  Consensus Reference Sequence
ratgacgaattttgaataaggattgaaaatatcattcataatttttkgaaattctgaaggggcattcttcagtccgaatggcattacattccwctcatattgcccgaaaggtacagtaaacgccgttttgtacctgtctgattcttggatttggatttgccaaaatccagatttcatatcaaattttgaaaatacttttgtagaatttaatctgttaagtaagtmttttttgtttggaataggatacctgatccattgtaatgcttgatttagtggtttgtaatttatgactaagcggggtgttcctygctcaatttcagattttttgttgacataaaaagccgcacaagaccatgggcttttgcttttccagattagacctttattaagtaaatccttaa

SEQ ID NO: 1071 - DNA, 401 bp, Artificial Sequence
  Consensus Reference Sequence
aagaaartttgtgttaatcctaaggccttggttttcaataattrcatttgatagcttaaaattaatttttaattttgagtcgtttgctgtactttgtttctctgaggttttttcaaagaattttgtaggaattaatccttctaaaatacagtttgtgtcagcccttgtctcaaatagggccattgtttctaaaacaaaattattaataattatttttatgtttatgtaaaatttttggattttaatcttgttgattaatcccataatatcatcttctagattttctggttggttttcctcaccrttgttgstactttcaraatcactaccttcctcaagctaagaaagaatgatytgatgaatttcttgttgttgaygaagttcttttacctcctttttta

SEQ ID NO: 1072 - DNA, 401 bp, Artificial Sequence
  Consensus Reference Sequence
attttgtaggaattaatccttctaaaatacagtttgtgtcagcccttgtctcaaatagggccattgtttctaaaacaaaatyattaataattatttttatgtttatgtaaaatttttggattttaatcttgttgattaatcccataatatcatcttctagattttctggttggttttcctcaccrttgttgstactttcagaatcactaccttcctcaagctaagaaagaatgatytgatgaatttcttgttgttgaygaagttcttttacctccttttttagattgtttatttctgtttggagatcttggatagtcgttggtttggttgaagaattttmtaaycttttgagtatgttacttacatcaaacttgttgtttgtaataaaatctttttgtcta

SEQ ID NO: 1073 - DNA, 401 bp, Artificial Sequence
  Consensus Reference Sequence
gtgtcagcccttgtctcaaatagggccattgtttctaaaacaaaatyattaataattatttttatgtttatgtaaaatttttggattttaatcttgttgattaatcccataatatcatcttctagattttctggttggttttcctcaccrttgttgstactttcaraatcactaccttcctcaagctaagaaagaatgatttgatgaatttcttgttgttgaygaagttcttttacctccttttttagattgtttatttctgtttggagatcttggatagtcgttggtttggttgaagaattttmtaaycttttgagtatgttacttacatcaaacttgttgtttgtaataaaatctttttgtctaggttttacctccaatgttttcttgagtttttccag

SEQ ID NO: 1074 - DNA, 401 bp, Artificial Sequence
  Consensus Reference Sequence
ataatatcatcttctagattttctggttggttttcctcaccrttgttgstactttcaraatcactaccttcctcaagctaagaaagaatgatytgatgaatttcttgttgttgaygaagttcttttacctccttttttagattgtttatttctgtttggagatcttggatagtcgttggtttggttgaagaattttmtaatcttttgagtatgttacttacatcaaacttgttgtttgtaataaaatctttttgtctaggttttacctccaatgttttcttgagtttttccagaaaaaccttcttttyctgggggtcrgggatggaattaattgcttcaaacaagagatcttgttctcttgttagagtattgatttkcctatcatcatcatccgtcgatga

SEQ ID NO: 1075 - DNA, 401 bp, Artificial Sequence
  Consensus Reference Sequence
agttcttttacctccttttttagattgtttatttctgtttggagatcttggatagtcgttggtttggttgaagaattttmtaaycttttgagtatgttacttacatcaaacttgttgtttgtaataaaatctttttgtctaggttttacctccaatgttttcttgagtttttccagaaaaaccttcttttyctgggggtcggggatggaattaattgcttcaaacaagagatcttgttctcttgttagagtattgatttkcctatcatcatcatccgtcgatgataawtggtcatcttgttggattaagtttagatcttygtcggaaagtacggaggatgaagtttctrtttcttcctccgaagtttctatgagcaaattgtttatttgttcttcgattgt

SEQ ID NO: 1076 - DNA, 401 bp, Artificial Sequence
  Consensus Reference Sequence
  misc_feature 222: n = A,T,C or G
catccgtcgatgataawtggtcatcttgttggattaagtttagatcttygtcggaaagtacggaggatgaagtttctrtttcttcctccgaagtttctatgagcaaattgtttatttgttcttcgattgtgggttctaggttaaggtttcttaatttcttctttagtctacaatacttactaatgtggccttgttttccataattgtagcacattatttttnattttattktttgcttasgattttccatttccwtactagttgagggtttttgtgaatatcttctttttgaaaatcttcttttattggctggtttatgatcctggatttctytcctagaggattgttttttcttttgttttgggcargctggtaagccaaattgttcacagaaggaacct

SEQ ID NO: 1077 - DNA, 401 bp, Artificial Sequence
  Consensus Reference Sequence
  misc_feature 192: n = A,T,C or G
ggattaagtttagatcttygtcggaaagtacggaggatgaagtttctrtttcttcctccgaagtttctatgagcaaattgtttatttgttcttcgattgtgggttctaggttaaggtttcttaatttcttctttagtctacaatacttactaatgtggccttgttttccayaattgtagcacattatttttnattttattttttgcttasgattttccatttccwtactagttgagggtttttgtgaatatcttctttttgaaaatcttcttttattggctggtttatgatcctggatttctytcctagaggattgttttttcttttgttttgggcargctggtaagccaaattgttcacagaaggaacctaaatccttctttgtttgagtcttttctttg

SEQ ID NO: 1078 - DNA, 401 bp, Artificial Sequence
  Consensus Reference Sequence
ctaccttttggacataggaaatcaattkaccatagcttaaattttcatatggaatgtctccattggcagattgactacgaattttatccctaaccttgtctcctaacgatctgggaagaccgrctagaaatttttctttccwgaaaggttgttggctatcttctctggtgtaaaccctagttaggaaagtatctctgtactacctaaaatctgctaaggttctacacttaagatttgataataattctgyagacctatctttccataaggatgggtctccaataaaatgttgagctattgtaaaaattaaggtattgacagcgtcaggaatctstttatcatcgtcattagtaatgacttttccattgagatccgtcttaactgcgctgtaaattttttat

SEQ ID NO: 1079 - DNA, 401 bp, Artificial Sequence
  Consensus Reference Sequence
tatmaaattctctaatatctttgcyctcatttggttccatagaaatatttccrtaagtaaatacgtaacaaaattttttggatctgaaatatttttaagcaaaaamtccttttttttwaaatagtttgaacgrmaatcctatarccaccagtatattatgtgttgatattttggttaaacagtacaccttarccttaytgtcctttatccatcacgggtcttactgctacagtaccattcaactaaaatattagactamtgtacttccagaaartactgttcaaacatctattgtayagatcaaaataaaatattactcatagtatacaaggttcyagatccataaaatttgtttacatatgtccttacggaccrtattyctacttccccatcaggctctg

SEQ ID NO: 1080 - DNA, 401 bp, Artificial Sequence
  Consensus Reference Sequence
  misc_feature 55, 56: n = A,T,C or G
tacatatgtccttacggaccrtattyctacttccccatcaggctctgataccagnnatatatatatatatatatatatatatatatatatatatatatatatatatatatatatatatatattattttttgggtaccaatatataatattattttttggatacaattaattttttttttttgaaactatcagactttgattacactccataacttctattcctataatcaargactttaattgcaatttaggygagtcatgtgtccttttatattcctsattattttgattgactttcctttttctttaactttcctattatgttcctactccataaaatattaaatatttattgtgaagaagacttttaaaaaggctatyaggccaggycaggcttttaa

SEQ ID NO: 1081 - DNA, 401 bp, Artificial Sequence
  Consensus Reference Sequence
  misc_feature 124: n = A,T,C or G
ccaratccygrttgcaccggtcygacctgatcagttttacacacaaaaagggaccatctctamgacatcattttgatatctaattattataaattgttatcttggattttgaagtatggatganwttttttttactcaaataatgttagttgtatacttatatataatatatacatatataattttgaatttwtataatatattaagtcaaaccagtccaatggttaatctatcagttggaccactgtccattcatcaaytattttaattggatcaatgaccgaacyaggtttcacaactatgattgcaakcataacattacaaaaaatamttaaaaaataaaataaaaaacaaacacaataataaagataatattgattaaaaaatttattattasattt

SEQ ID NO: 1082 - DNA, 401 bp, Artificial Sequence
  Consensus Reference Sequence
attaaamwtwwaatttttatcttttaaagataaacttgtaagcatgagaaaagaaaatagttattaaaaaataaaaatgaaagayctttactcattcaatgattcgagtctgacccgygtgaactcaggattctgaatcwggaacarcgatctccgtccgatccacatgtaaggtacgaccrcraatyagtaacaracacgtgtctcatcattcgtgcarctgccatttgtatatawagcacaacacragaagacgytaacyggctggtactgcaaatattcatccaccacgtggygccatatgatcaratgaccttgctactagtcacgggaagagcccgccttgtggttaggtgttgaaggatgtttggcgrcaaattraccaaatagggtywctttta

SEQ ID NO: 1083 - DNA, 401 bp, Artificial Sequence
  Consensus Reference Sequence
ccatttgtatatawagcacaacacragaagacgytaacyggctggtactgcaaatattcatccaccacgtggygccatatgatcaratgaccttgctactagtcacgggaagagcccgccttgtggttaggtgttgaaggatgtttggcgrcaaattraccaaatagggtywcttttayaaatattttatcaaatagggtctgttttaaaactatggacgaggggggtctgttttttaatggatgtcgccattgaagctrgmgatacarytgagtcgccattggcactggcaagatagtgctgacrtggaggtgtttcgccattggcawtggcgaaacacgtracgtggaggtgggtctagccagcagcactggcraaacaggtgaggctagggcagctag

SEQ ID NO: 1084 - DNA, 401 bp, Artificial Sequence
  Consensus Reference Sequence
ttttaaaactatggacgaggggggtctgttttttaatggatgtcgccattgaagctrgmgatacarytgagtcgccattggcactggcaagatagtgctgacrtggaggtgtttcgccattggcawtggcgaaacacgtracgtggaggtgggtctagccagcagcactggcraaacaggtgaggctagggcagctaggtctggtgttgywgagtaggggygcagtggttcaggatggtttcactaacatggctggygagtttgttttgaaagtatctcgycattgttgctggcgagaaaggtgcctacgtggcrcwcatgcatgcaaactgaaagtagcagcatataagaagyagrcttttccagaaaccttttcagaaagggtttcgcaagtgggagtg

SEQ ID NO: 1085 - DNA, 401 bp, Artificial Sequence
  Consensus Reference Sequence
gtgttgywgagtaggggygcagtggttcaggatggtttcactaacatggctggygagtttgttttgaaagtatctcgycattgttgctggcgagaaaggtgcctacgtggcrcwcatgcatgcaaactgaaagtagcagcatataagaagyagrcttttccagaaaccttttcagaaagggtttcgcaagtgggagtggcggaataagcttctcccctawaaaacgatyatacrcraatgaatggaaacatctgygtattctggtgaatttcctagtgcttggtgcttgttacgcttgtgytggtggtgaaaagcatgagttgrgwattctcttcttgctttctcaaacttggtaaatagttaatatttgttgtgttaattttttttttctgttgcttgat

SEQ ID NO: 1086 - DNA, 401 bp, Artificial Sequence
  Consensus Reference Sequence
ggwatatatattgttwaaatttttyttttgttattttaarttattttgggtattctaataacaaaaaacctckttactraaacttcaaattaaaactttattctaataaaaaattaattacttcaaataaatatcatgcmaraaacttaaaaaacttgtacrctttcaaagtagaaattttaaaggcamatcaaaccatcgacraagttgctattataaataattaatcttaaawataataacttcaaaacwaaataaatctaattaaaaaaaatactacrctcaaamtttarattaaaaatttattctaacaaaaaattaattatatgatgcagaaacttaaaaaacttgaaygctttgaaagtaaaaawtttaaaggcagaayggaaacctttgaaagt

SEQ ID NO: 1087 - DNA, 401 bp, Artificial Sequence
  Consensus Reference Sequence
acttgaaygctttgaaagtaaaaawtttaaaggcagaayggaaacctttgaaagtagacattttaaaggcagaacaaatcattaaagaagttgytattataaataattaatctwaacattaataactwcaaaataaamaaaatctaattacaaaaaatactygaaactcaaattttattcmagactcaaaataattacttcaaataaataaaaacgatgccagagaagagaaattactgattgagagaaactttaaaaacacttrgaacactcagaaatttttaaaggcacaaagcatcarcacraaagyatcaacaygaagttgctayttaaagggcacarcacacctattttgtcaataccattggcgatatatgctcyttgtttcgccaacactgrtt

SEQ ID NO: 1088 - DNA, 401 bp, Artificial Sequence
  Consensus Reference Sequence
aaactttccaagaagtctgttatgggtagggtagagagagagagactatgctaattactgggacttgtatcaatattctcatgcctttattcatgaatataatgctccttttatacaatggtgttacaccgttatggctcgtaacgaaccaagcttaacagaataacggtctaactaacgtaactaactggtctctaatgggtgatacatcatgtacgtgaacctatatgtaatcctcgagatacttagggcgtgaggtttaccttctagaacgtccctcgtggttccttgttgcagaactaataccagtcgtagtgttgctaacatcaccttcccctgggaaactcaccttgtcctcaaggtgatgatgactgcgaatatcctcccagttttcccaagtt

SEQ ID NO: 1089 - DNA, 401 bp, Artificial Sequence
  Consensus Reference Sequence
tcatgtacgtgaacctatatgtaatcctcgagatacttagggcgtgaggtttaccttctagaacgtccctcgtggttccttgttgcagaactaataccagtcgtagtgttgctaacatcaccttcccctgggaaactcaccttgtcctcaaggtgatgatgactgcgaatatcctcccagttttcccaagttgagtcctcgggtggtaaaccctcccattgtataagtactgagcgagtagggggagacgtggaggtatccagtcgcgagttgaggatagtaagtggcttcaaaagaggttgattgtggaccgcgtctggtggtaacggagaygttgggagttcaaaagggccgtggtgcggtcstaacaacgagcagtgaaatatgggatgtattctaga

SEQ ID NO: 1090 - DNA, 401 bp, Artificial Sequence
  Consensus Reference Sequence
aaactcaccttgtcctcaaggtgatgatgactgcgaatatcctcccagttttcccaagttgagtcctcrggtggtaaaccctcccattgtataagtactgagcgagtagggggagacgtggaggtatccagtcgcgagttgaggatagtaagtggcttcaaaagaggttgattgtggaccgcgtctggtggtaacggagatgttgggagttcaaaagggccgtggtgcggtcstaacaacgagcagtgaaatatgggatgtattctagatccttgaggaagctgcaggcggtaagccacttgtccaatacgttccaagatgcaaaatggtccaaaatagcgtttggcgagtttattgggccttccctgtcgtaacgaaagttgacgataaggccgtagttt

SEQ ID NO: 1091 - DNA, 401 bp, Artificial Sequence
  Consensus Reference Sequence
gcgaatatcctcccagttttcccaagttgagtcctcrggtggtaaaccctcccattgtataagtactgagcgagtagggggagacgtggaggtatccagtcgcgagttgaggatagtaagtggcttcaaaagaggttgattgtggaccgcgtctggtggtaacggagaygttgggagttcaaaagggccgtggtgcggtcgtaacaacgagcagtgaaatatgggatgtattctagatccttgaggaagctgcaggcggtaagccacttgtccaatacgttccaagatgcaaaatggtccaaaatagcgtttggcgagtttattgggccttccctgtcgtaacgaaagttgacgataaggccgtagtttgacrtagactagctgtcctacctcgtactgaa

SEQ ID NO: 1092 - DNA, 401 bp, Artificial Sequence
  Consensus Reference Sequence
aaacgtccttcgccatggaaggccactgaaagcttgattgcaggcggtgtagggttttctttattccaaaatgacccccaattggtgttgcatggaactcatgtaacaaggaaggtatgaaggaattctttgaatctagccagatcactcctcaaaaaaggatgaggtcgccggagatggcaaaatcgcgatactgctccggatgggcaagtacggcggcgcgttgttgctggaattcagggctggccttaaacgtctcctttaactgagtcataaactcatggtgaggtatcgaaaggataaggcattgagcctgggacragcagtcaatttgagagagagaatctgcgactatgttagaagaccctgccttatattgtatgtcatagtcaaaacccaaa

SEQ ID NO: 1093 - DNA, 401 bp, Artificial Sequence
  Consensus Reference Sequence
aggaattctttgaatctagccagatcactcctcaaaaaaggatgaggtcgccggagatggcaaaatcgcgatactgctccrgatgggcaagtacggcggcgcgttgttgctggaattcagggctggccttaaacgtctcctttaactgagtcataaactcatggtgaggtatcgaaaggataaggcattgagcctgggacgagcagtcaatttgagagagagaatctgcgactatgttagaagaccctgccttatattgtatgtcatagtcaaaacccaaaagcttggctaggtagaactrttgttcaggtgtctgaaccacctgagacattaattccctaaggctcctttgatctgtgtagactgtgaaccgatggcccagcaagtattgccgccatcgt

SEQ ID NO: 1094 - DNA, 401 bp, Artificial Sequence
  Consensus Reference Sequence
atatatcaatatatcataaaaaaaaaccgctacgcatttcctcaggaaggggttgagtaaagcattcatggctgcttggaaggtcgagggtgygttgcataacccgaaaggcatcactctatactcatagtggccattgtgggttcgaaaggcggttttaggaatgtcactatctgccattaaaatctggtgaaaaccctgtcgtaagtccagcttcgaaaaccatgaagcatggccaagctcatccaagagttcttcaatggtgggtattggaaaccggtctcttattgtgatcgcgtttaatgctytgtagtcaatgcacatgygccatgtgccgtccttctttttcaccaataacacgggtgaagagaatgggcttctgcttggctgtattaacccgg

SEQ ID NO: 1095 - DNA, 401 bp, Artificial Sequence
  Consensus Reference Sequence
catagtggccattgtgggttcgaaaggcggttttaggaatgtcactatctgccattaaaatctggtgaaaaccctstcgtaagtccagcttcgaaaaccatgaagcatggccaagctcatccaagagttcttcaatggtgggtattggaaaccggtctcttattgtgatcgcgtttaatgctytgtagtcaatgcacatgtgccatgtgccgtccttctttttcaccaataacacgggtgaagagaatgggcttctgcttggctgtattaacccggactcgagtaaggcagtgacttrtttttcaatttcrtttttctgagagtgggggtacctataaggtctaacattgactgggtgagctgaaggaatgaggttaatgtgatggtcatgctgtctrggt

SEQ ID NO: 1096 - DNA, 401 bp, Artificial Sequence
  Consensus Reference Sequence
tctattaagatagtgacacgtgcgtggttgataacaccatataagcggaaggtatcggtggccgggactcccgccataacatgtaagctgatgtgaggttggagaagamtggggtcgtagggtgggggtgtttctgttaaaggttgaggaagggtttcgtggaggttattatcggaagctgagggcgcatcggagtctgcgatgaacaagagcacacgccctttacatcgatgggaggagctccatttttcgtcacaattgtagcataggcctttttcgygcctatgcatcatatyttcaggagtgcgctggataaagggagtcttgggtcgagggtgttgagtcagagtggaggattgcggagttgaggtttggggtatcagtgaggagggccgtgagtt

SEQ ID NO: 1097 - DNA, 401 bp, Artificial Sequence
  Consensus Reference Sequence
tcccagtgggtcatggtygtcaaaacgtggtacgtcaagcttgacaggagggcgctgatgtatacgaggggaagaggatggttgttgatatggcggtatggaagaaaagcgttcacacatggcgtctactctagaggctagctcggagtgttttgcrgcgagggtggtgagggcctcctcgaggcggtcggtggtggcgcggcgagtaccgtgctccgccataatagcaggtcggaccaagatsttatgggtagggtagagagagagagactatgctaactactgggacttgtatcaatattctcatgcctttattcatgaatataatgctccttttatacaawggtgtyacaccgttatggctcgtaacgaaccaagcttaacagaataacggtctaact

SEQ ID NO: 1098 - DNA, 401 bp, Artificial Sequence
  Consensus Reference Sequence
ctgcatataaacatcaaggttcatacctggaccttttggaccaggaataagcaatgaaagtataaaattaggttgcttcatacgcatccatggaggaagattgtacggaatcaagataacaggccaagtgctatgggaaattgccatagttttgaaaggattaaagccatcagtagycaaacctagtcgaacattacgagtgtcacaagcaaaatcaggataytgacaatcaaaattcttccaagcaaatgaatcagctggatgcctcaggagtccatctttagttcgaccaacctcatgccatatcatagaacaagctgtttttggtgatacaaaaagtctttgcaatctaggtataagagggaaccaacgaagaatctttgctggtatcttttttctac

SEQ ID NO: 1099 - DNA, 401 bp, Artificial Sequence
  Consensus Reference Sequence
aagtattttcctctggtaatgcatcacttaacagctctaacaacatcgaaaaacttttatcagtccacccatttagacactttaagtgatacaaatgtacaaggaatgacaattttgtaaacttcwtacaacctttataaagactttgctctgcctcccttaacatctgatagaacttatctgaattattattgtcttcatatttttgaacactcggtccattcataaattytctagaatctccatcctccatatttatatctrtgtcattactctcattagttgcatgcattgtgaatgcatcatgaaccaatgtatccatgtcatgatcaaactccccttccacttgggatgtatctaaagaactagatgggccaacttgttcaccatgaaagatccaa

SEQ ID NO: 1100 - DNA, 401 bp, Artificial Sequence
  Consensus Reference Sequence
tctrtgtcattactctcattagttgcatgcattgtgaatgcatcatgaaccaatgtatccatgtcatgatcaaactccccttccacttgggatgtatctaaagaactagatgggccaacttgttcaccatgaaagatccaagtaacatatccttttagaaatccattactaataatatgctcataaacattcatccgagagcrccacttgcaattgacacatttggtacaagggcataaaattttcccatcctttgacgwtttcgcaaatgcaaaatctagaaaatttaaaattcctctaatatacttctctttattaagagaattgtagtctatccaactcttatccatttgataaaataaactgaaaaagtagaataaaatagacataataaattagtg

SEQ ID NO: 1101 - DNA, 401 bp, Artificial Sequence
  Consensus Reference Sequence
ctaagaataataggttaataagagtggattaaaattaataattattagtaacatcttttttattaaatgcttttacagyattcttttttttaataagtaaaattctatgttgcccaattactaaagagtaggcttgatttattcggtgagattcactcatgatttattaaataaaaaatgcttaaaatagtaaacaatatttttactagaattcctcattgaaaattagaaacttcttcctaccgttaactttataaaaacatatgtatcttttaataattggtgagtaatatatatattgtcaacctctattaacttcatcttatctagagtaatattctctctcaaaggctgcagacaacagggaagcaaaaatggaccttgaatttgggmattaaaat

SEQ ID NO: 1102 - DNA, 401 bp, Artificial Sequence
  Consensus Reference Sequence
tattgtcaacctctattaacttcatcttatctagagtaatattctctctcaaaggctgcagacaacagggaagcaaaaatggaccttgaatttgggmattaaaatcagaaattaactaaaaaggtaggatcattctttcattcattcacacttaattttcttgttcggtgactatcacctatatataggaacaagaaatccagcaaacatttttttatgttgggtgactattcatccaatagaaatcaagcaaacatttttatatttatatggaaagaccataattttgaaaagtacttgaaatatgatgagcccaatgaggactggctgtgtatcaaaccaaaagcttcgatacagataagctgaatttcgcactagtgtatatcctccaaattgtagaa

SEQ ID NO: 1103 - DNA, 401 bp, Artificial Sequence
  Consensus Reference Sequence
gaatgtaactatgaggtattcaacacattccaaatttttgtctacattccaaattgcttagccacttagacccctaaagataagtcccaaactttttgtccacattccaaatttaccgcacacttctaaaatcatcctcattgtcggtcaatagcttaaactattttacagaaaaccaataatacatacacacacacacacaaatcgaaaacaaaaactaccaagttcctatcctaatcctccataataactaaaacagattacacaaattccaacaaactccactgattgcttcatccgaaacaccaccaccacaaaaaccaaaaaaagaaaaatcmaaaccagattgaacactcaacgaacaaaaccaaccaatcttcaatccgatcrtccgaaaacca

SEQ ID NO: 1104 - DNA, 401 bp, Artificial Sequence
  Consensus Reference Sequence
acacacacacamaaatcgaaaacaaaaactaccaagttcctatcctaatcctccataataactaaaacagattacacaaattccaacaaactccactgattgcttcatccgaaacaccaccaccacaaaaaccaaaaaaagaaaaatcmaaaccagattgaacactcaacgaacaaaaccaaccaatcttcaatccgatcgtccgaaaaccacaaatattcaaaattcaacattttcgttgaaaaaattccaacagccaccatctcacacactcatctcaaatcgattcacacaaaaaaaaatccacaaagttttagawtgaaaaaaaaamasataatccaaacacaaaaaaagaaggaaaaataaacaacctcacagatygatcyggcaagctgcggaaa

SEQ ID NO: 1105 - DNA, 401 bp, Artificial Sequence
  Consensus Reference Sequence
atctcaaatcgattcacacaaaaaaaaatccacaaagttttagawtgaaaaaaaaamasataatccaaacacaaaaaaagaaggaaaaataaacaacctcacagatygatcyggcaagctgcggaaaakagaaagggatcagggaggtgaatcgcgatygaagtgaagatcgtgagtggaaagsgcggagaatgcgtagttgtggaaagaggaaaaagacgttggaaacagtgagagagagagagcaaagaaaggaaactaaggcraaagcatcatggtcgtcatcggaaagagagaaatttagggttccgaagaagaagaagagaaaagagatatggggtgggttattacccttcctttggttatcgctctctattgctcttttttttcttctttttttt

SEQ ID NO: 1106 - DNA, 401 bp, Artificial Sequence
  Consensus Reference Sequence
caagagaatagtattcaaattcaaatagtcttaaagagttttacctacaccaacaatcataggtataagactagattttgtgaagttttatctacatcacgtagttgtaggtataagttttttaaaattttgcctacactgtgcttctgtaggtaataattcttttgagttttatctacactaatcaaccataggtacaatttttttggagttttacctacacaacatagttgtaggtagaagtatttttttagttttaatgaatttgcctacgccaaataatggttggtacaagtggttgagttttacttacattagtcaggcgtagrtaaaagtattgttgagatttacctacactagtttatgtctgtagcaaaaaagcgtctgtaggcataggttat

SEQ ID NO: 1107 - DNA, 401 bp, Artificial Sequence
  Consensus Reference Sequence
  misc_feature 373: n = A,T,C or G
tttgcctacactgtgcttctgtaggtaataattcttttgagttttatctacactaatcaaccataggtacaawttttttggagttttacctacacaacatagttgtaggtagaagtatttttttagttttaatgaatttgcctacgccaaataatggttggtacaagtggttgagttttacttacattagtcaggcgtaggtaaaagtattgttgagatttacctacactagtttatgtctgtagcaaaaaagcgtctgtaggcataggttatttttcttgtagtatrtaattcaattttattttgtatattgyatgtaggctaccgtagttttttttccaacaaaatgatttgtattaaatggtaccaaaantacctaagatccaaaaacatatacacca

SEQ ID NO: 1108 - DNA, 401 bp, Artificial Sequence
  Consensus Reference Sequence
caaacaccagcaagagaagaaagttcatggttttttgccttatataacaaccactgccatgagatatgttttacggctgtcaaaataccccctggttcacactttttgcaactaaaggctatcatataaaatatttmtgttggccraaatcggtttcttttgatcgacatyggtcgaagttattttttgtccaacgttagttagaaattttttttgtcaacgttagtcaatgatgtttgtgattgatatcaaccgatgataatattttatcaacatcttgtcagggctatttttcgaccaatcgtaaccttggtttttttggtcaatgtgacaaagcttcgttaccaggaacaacttgaggcacttgtagactcgcttgtcaggtttttcatcattgacac

SEQ ID NO: 1109 - DNA, 401 bp, Artificial Sequence
  Consensus Reference Sequence
agaaaaaaaatatgaaatcaagatcktgtggagtgtctaccaatctcaargctgaactccatgccatcttttawggtctctrtcatgccttgaatctaggcttcaattagtttaygagtctgattctatagtggctcttaaactcrtcctaggaagaaattaagtaattaacswacaagtttcatcctcacgtatgctaccctcatcaacttaatcagctcactgctggagcaagattggaggatccaggttcagcatactcttcatgaagacacgtatgtgcaggttggcatgcaaagttaatttggaghgtgataattcatttctggtttggcaaaatttcccacctcaagtatctgtgtctcttttagtaaatgcagtagggattctaagattatgtg

SEQ ID NO: 1110 - DNA, 401 bp, Artificial Sequence
  Consensus Reference Sequence
attcatacacactatagttctaggatattctaccattttcatacatattatatttaagaatattctaraaatttgtarcaatttcaacactcctgcttgatgcaaatttctgtgactccgagcatagctcgtaattcttcaaatcttggtctcggcaacgccttcgtgaatatgttagcaatttgatcttctgttctgcagtagtcgagtttgatctctttagttgctttagcttctctgataaagtgatacttgattgctatgtgttttgttctgywrtgatgaactggattcttcgccattgyaattgctgatttgttgtcgcwgttgattttagtaggctcatcttrtttttctcccatgtcttcaagtatccwacgaakhcatatagcttgactcgt

SEQ ID NO: 1111 - DNA, 401 bp, Artificial Sequence
  Consensus Reference Sequence
gcatacattatgtcaggccrtgtagcttragacttgatgtaaagtgtaggctcactcttgctcctactgaatcctcaatccatgaaatactaatcgattctactataccatgctcgaggtgyttgctttaaaccgtagaatgcttttcttagtctgaacactttgctttctttgccttcagacacgaatccttttggctgttccacatagatcttttcttcaagtacgccgttaaggaaggcggatttgacatctagttgatggatactccatcctttttgtgacgcaagagctattagaactcttatggtatcaagacgagctactagtgcaaatgtctcattgtagtcaattccgggttgctgtgagtaaccsttagctactagcctcaccttgtgttt

SEQ ID NO: 1112 - DNA, 401 bp, Artificial Sequence
  Consensus Reference Sequence
tggagatgaaggtggttcacctggatcttcttcctcagcttcttcttgaggtagttgggcgagtataagaatgttcttctccactttttcttcatcccaattccaagaagtgtactcatcaacttcaacatctcgaytgatgacgagtttcttagtktgcaagttgtagacacggtagcccttagagatattgttatacctaaggaagatacctcgtatagtcttgtcttcaagcttgtgcctcttcacgtctggaatattaatgtagcatatagatccaaagacccttaggtgctttgttgatggcttcttcccgttccaagcttcaattggagtcttgtcttttacagacttagttggacatttgttgagtatgtaaacagcagtgtagactactttag

SEQ ID NO: 1113 - DNA, 401 bp, Artificial Sequence
  Consensus Reference Sequence
gaactttttgaatactccaaagaattctgatttttcttttagaaaatatacccatgtcattctagagaagtcatcaatgaagagtatgaagtacctgttgttctcatgtgatgacgtcctcattggtccacagacgtccgtatgtatcaagtccaacagatctttcgctctccatgctcckcttgttgagaaaggaaatcggtgttgcttaccaaggagacatccttcacacacttcattgttctcctttatgcttggaagatctctyatcatgttcttctcatgtaacaatttcaaggcatgtgtgttgaagtrgccaaatcttcgatgccatarccatgaatcrtcaacttgtacctttatctgtctccacyatgayagtgcctttgccttttgattcr

SEQ ID NO: 1114 - DNA, 401 bp, Artificial Sequence
  Consensus Reference Sequence
ttgaaatttaagctttgattggaaggcattttcaagtgtatcttctttatgtctatacagtctttgctcatatgcttcaagagagcccacaagttctgtctckgatagagtggacagatctttggtttcctcaatcrttgtcacgattgggtcaaacttttggggcatagtaattagaattttctcaacaattttcttatcaaaaatatmttccccaaaagctctcatttgattaactatttctttaactttagaacagtaatctttaactgtctcagactccttcatcttcaatagttmaaaatctcttcttagagattgaagtttaacggcacgtaccttaacacttccttgaaactcctcctgcaatgtgttccacgcttytttgvyagwcttagctc

SEQ ID NO: 1115 - DNA, 401 bp, Artificial Sequence
  Consensus Reference Sequence
gctgaagtatctgtgggaacggtgaaaccttcttctaytatgtcccataaatcttgakatgaaaaatatgtttccattttaacacgccakaaatcataattttcacmattgaagatagggayaaaaatagttgacgattgagtagtgttatccatagcttagaaaaaatattattggagtgggttaataatacaaagaaatwttttcaagtagttkggaggattttggaatggtaggtagrtaatataactaygccyaatgtatgaccraacgtagctctrataccamtgttgatagttgattagatgatagttgatagttttagagaattgttttagaaagaaggccatgtcattgatttcttggatcatcaattacaacataccaattgcctatttaca

SEQ ID NO: 1116 - DNA, 401 bp, Artificial Sequence
  Consensus Reference Sequence
ggggggwcggatgtgcttcattttgaggaggctttttccggaacaggtttgttatatttttattgcatgttatttagaattaaagtctagttattatgtcagttgtgcatatagcttgcgtcaagtgaatcaacaaagattgaactcgattcatattatattgatttaatagttatgtttcttaactgggaaaatattgagattcttagaacatctttagtcaaagaatccattttaggttcttggattatttttttgggttccatgatgttataggatgcaagaatttttatcattttttgttctagtagtagaatctaatttggattattagattttactagcacaagaaaaaaaatatttttgaaaaaataggagttcttgggagttcttttcctaga

SEQ ID NO: 1117 - DNA, 401 bp, Artificial Sequence
  Consensus Reference Sequence
atggaccccctttccccaaagaaaaccctcctctttgttttcatcatttccttctcttctcttcacctacaacacacaagtgggtttgagggccaagtgtgagagagagattgggagagaagtcaggtttgagagttgaaggaagttactggtggtagctggtgttggcacgagcaatggcacgaatgacagcgccagtggtggccggtggctaggttggaggtgacccttgagaagggagaacaagaggagataaccatgaaagctagagtttgyggaaagagctcatgactacgaaaggtcgacgacaagtttagacatcactatcccactcattttttcgtgctctacgcaatggaccgagcrgaatcgcattttggggtaaggttttgttgaccttc

SEQ ID NO: 1118 - DNA, 401 bp, Artificial Sequence
  Consensus Reference Sequence
acaagtgggtttgagggccaagtgtgagagagagattgggagagaagtcaggtttgagagttgaaggaagttactggtggtagctggtgttggcacgagcaatggcacgaatgacagcgccagtgrtggccggtggctaggttggaggtgacccttgagaagggagaacaagaggagataaccatgaaagctagagtttgtggaaagagctcatgactacgaaaggtcgacgacaagtttagacatcactatcccactcattttttcgtgctctacgcaatggaccgagcrgaatcgcattttggggtaaggttttgttgaccttcttctacccatcaaactattttgatgtgttctcttagaaaccttatccatttgaatttcttgagttgtgagttgac

SEQ ID NO: 1119 - DNA, 401 bp, Artificial Sequence
  Consensus Reference Sequence
gacatcactatcccactcattttttcgtgctctacgcaatggaccgagcrgaatcgcattttggggtaaggttttgttgaccttcttctacccatcaaactattttgatgtgttctcttagaaaccttatccatttgaatttcttgagttgtgagttgacttggtttgatttgaaaatgtaaaattgattgaaaagtcttcaaaatcgttagtgaggacctcttcaccttagatcttcacgagtgacgaagtcatagtgacaaatccataaggtatagaagaaactataatgagttgtgtgaaaacgcagaggaatgttgaagaatgattctttgatgcccaagggaccaagaaaaatagagaaacaaaaagattaaaaccatgcaataaaatgacatcat

SEQ ID NO: 1120 - DNA, 401 bp, Artificial Sequence
  Consensus Reference Sequence
gcacctccaatccactctagtagctatatctccggtgatcaaggagatagaacagcaaaacaacgagttgaagcttccaaaggaggaacttcaatcgtttatcagaaagatggaggaggggacacmgcttgttttcgagtgttcaaaaatccggtggctacactttgtgactagggcttgttacaaggacaaactggaccggttttccgacgagctcgtgaaactatttgccatcgacatgcaagctcagatggcaagagatckgaaggagaccttgcttaaagttaggagaatamttagggttgttgagaaaacgtgcttcgaccctgggraggcaattgacaacacagtgttaaggtttttgacgtggatttctgtctttgctgtgaagctaataaggg

SEQ ID NO: 1121 - DNA, 401 bp, Artificial Sequence
  Consensus Reference Sequence
gcaagagatckgaaggagaccttgcttaaagttaggagaatamttagggttgttgagaaaacgtgcttcgaccctgggraggcaattgacaacacagtgttaaggtttttgacgtggatttctgtctttgctgtgaagctaataagggtaatttctgctttgagatggatttttctgacgctaataagggtagcttttacgttttcttccactaaacaggagcarttttcacttgataaacaattgaagagraaaaaaggctacttgctctctgccaggagtctcacaattttttgaactgttycaggggtcaggtaattatttcttgttttctaattaattagaaaattgtgccaatatgtttatttggttcaattactccgttacttgaattcttatat

SEQ ID NO: 1122 - DNA, 401 bp, Artificial Sequence
  Consensus Reference Sequence
ggtttttgacgtggatttctgtctttgctgtgaagctaataagggtaatttctgctttgagatggatttttctgacgctaataagggtagcttttacrttttcttccactaaacaggagcarttttcacttgataaacaattgaagagraaaaaaggctacttgctctctgccaggagtctcacaattttttgaactgtttcaggggtcaggtaattatttcttgttttctaattaattagaaaattgtgccaatatgtttatttggttcaattactccgttacttgaattcttatatgttgatttttttaaaataaaaatacgatttaagagatataaataattttcatgattgaagagttttttataataattgttgtaattgaaaagtagtttctagt

SEQ ID NO: 1123 - DNA, 401 bp, Artificial Sequence
  Consensus Reference Sequence
ccattgtccttaagatattgatttaagatcgaaactaagaaaaaaaagtatttgttacgaaaatcataaagagaacataaggacactggttagcatttttcaataaacttgttagaacttgcgagaagaaagaagaagggaagaagggaaatatgctaagctaatactgggaatgagtttctctgctttattcatgagtggacttgttcttttatacatggttccatatgacagtggcctattatggcctgcaactaccccgcaataacagaatarcggtctattctaaccaactaactatattctaactaactgggtacgtctgcatggcttctgcatgagtgcttcttatacgtagtcctcgaggtgtttaggacgtgagacttcccttcgtggtcatg

SEQ ID NO: 1124 - DNA, 401 bp, Artificial Sequence
  Consensus Reference Sequence
cataaggacactggttagcatttttcaataaacttgttagaacttgcgagaagaaagaagaagggaagaagggaaatatgctaagctaatactgggaatgagtttctctgctttattcatgagtgracttgttcttttatacatggttccatatgacagtggcctattatggcctgcaactaccccgcaataacagaatagcggtctattctaaccaactaactatattctaactaactgggtacgtctgcatggcttctgcatgagtgcttcttatacgtagtcctcgaggtgtttaggacgtgagacttcccttcgtggtcatgccatcggaacggtgctaacaaaacttttgcatttatactacttaatatgtgtgtagcttttcttaaggaaaaaaa

SEQ ID NO: 1125 - DNA, 401 bp, Artificial Sequence
  Consensus Reference Sequence
aaagggttgcctgcatgaataaaacgggagaatattttgagaaaagcttagtttagtatgagggaccttgacctcgaaccaaggtataccatcttcttcctctctgctctcaaaaactggtccgacctgcccttttccatggcagagcatggaacctgccgcaccactacagatcacctcgaggaagccattgctrcccttaccgagaaacattccaacttggccaacaagttcgaggccatgtgcgagcgtctctctcacatgtcttctactgcgccaccgcctcctcagatccctcggccaccggtcaagctcgacgttccacgttttgatgaccatgacccgcttggatggatcttcaaaatttctcagttcttcgactaccaaggaactccagaaga

SEQ ID NO: 1126 - DNA, 401 bp, Artificial Sequence
  Consensus Reference Sequence
atttctcagttcttcgactaccaaggaactccagaagaggatcgaatcatggtagcttcattctaccttgatggccccgcactcagctagtttcagtggatgtttaggaacggattcatcacttcgtggccagctctcctccaagcaatcgaatcccacttcgctccctcgatctacaacgacccccacgaagctttgttgaagctgattcaacgaggtatagtaacggagtacctaacggaatttgagaagctagcgaatcstatcaccagactgtcatcgtcggttctcctcagctgtttcatctccggcctgagtcygaaatatgtcgtgaggtacaagctttccatcctgtatctttacctaaagctacagctcttgctcgtcttcaggaagacaaa

SEQ ID NO: 1127 - DNA, 401 bp, Artificial Sequence
  Consensus Reference Sequence
ctaccttgatggccccgcactcagctagtttcagtggatgtttaggaacggattcatcacttcgtggccagctctcctccaagcaatcgaatcccacttcgctccctcgatctacaacgacccccacgaagctttgttsaagctgattcaacgaggtatagtaacggagtacctaacggaatttgagaagctagcgaatcgtatcaccagactgtcatcgtcggttctcctcagctgtttcatctccggcctgagtcygaaatatgtcgtgaggtacaagctttccatcctgtatctttacctaaagctacagctcttgctcgtcttcaggaagacaaaattaacgatcaycggaaacacgtccggtcctcgtttggccacccaccaccaagtaacaccac

SEQ ID NO: 1128 - DNA, 401 bp, Artificial Sequence
  Consensus Reference Sequence
cacttcgtggccagctctcctccaagcaatcgaatcccacttcgctccctcgatctacaacgacccccacgaagctttgttsaagctgattcaacgaggtatagtaacggagtacctaacggaatttgagaagctagcgaatcstatcaccagactgtcatcgtcggttctcctcagctgtttcatctccggcctgagtctgaaatatgtcgtgaggtacaagctttccatcctgtatctttacctaaagctacagctcttgctcgtcttcaggaagacaaaattaacgatcaycggaaacacgtccggtcctcgtttggccacccaccaccaagtaacaccaccccctctaaccctcacactacccagacagctcgaccgaaacccccttttgtccaaag

SEQ ID NO: 1129 - DNA, 401 bp, Artificial Sequence
  Consensus Reference Sequence
atccttccataaccgaacttgacccaatcatagatgaccccarccagcttttcgatccaacctcgcttcaacctcatataagtctccacgccatggctggcgtgccggccacggataccttcagactatacgggcttatcaacaacactcgcgtcaccatactagtggacarcggcaacactcataacttcgttcaaccctgtgttacgaagttcctcaatttacccatgcaagataggatgcctctcagagtgatggtgggcaatggctctattttggactgycrgcaattgtgccctgataccaagatactcatccaggatcacacttttgttgtcaccttgcgcgtcttgctgttaagtggaaccracgttgttttgggtgtggaatggttacgtacg

SEQ ID NO: 1130 - DNA, 401 bp, Artificial Sequence
  Consensus Reference Sequence
ccacgccatggctggcgtgccggccacggataccttcagactatacgggcttatcaacaacactcgcgtcaccatactagtggacarcggcaacactcataacttcgttcaacccygtgttacgaagttcctcaatttacccatgcaagataggatgcctctcagagtgatggtgggcaatggctctattttggactgycggcaattgtgccctgataccaagatactcatccaggatcacacttttgttgtcaccttgcgcgtcttgctgttaagtggaaccracgttgttttgggtgtggaatggttacgtacgwtgggcccaatcgttactgattacaccgcttttactatgcagttcaccttttttggcaggcccattaatctcctcgctaatgttc

SEQ ID NO: 1131 - DNA, 401 bp, Artificial Sequence
  Consensus Reference Sequence
acarcggcaacactcataacttcgttcaacccygtgttacgaagttcctcaatttacccatgcaagataggatgcctctcagagtgatggtgggcaatggctctattttggactgycrgcaattgtgccctgataccaagatactcatccaggatcacacttttgttgtcaccttgcgcgtcttgctgttaagtggaaccgacgttgttttgggtgtggaatggttacgtacgwtgggcccaatcgttactgattacaccgcttttactatgcagttcaccttttttggcaggcccattaatctcctcgctaatgttcaagtggatacctacccagtctcggcccatcaggtgaagcgcttgatcaccactaactccacttcgggtttatttcacttatca

SEQ ID NO: 1132 - DNA, 401 bp, Artificial Sequence
  Consensus Reference Sequence
gtgttacgaagttcctcaatttacccatgcaagataggatgcctctcagagtgatggtgggcaatggctctattttggactgycrgcaattgtgccctgataccaagatactcatccaggatcacacttttgttgtcaccttgcgcgtcttgctgttaagtggaaccracgttgttttgggtgtggaatggttacgtacgttgggcccaatcgttactgattacaccgcttttactatgcagttcaccttttttggcaggcccattaatctcctcgctaatgttcaagtggatacctacccagtctcggcccatcaggtgaagcgcttgatcaccactaactccacttcgggtttatttcacttatcacttctacccatccctcaacccgaaacagcgagc

SEQ ID NO: 1133 - DNA, 401 bp, Artificial Sequence
  Consensus Reference Sequence
gcatcgtggttttcaaaactagacttaagacagggcttccatcagaatttaatggcggaaagggatatcccaaaaacaamctttcgaactcatcagggacattatgagtatagagtcatgcctttcggcctgtgctacgygccgtcgacgtttcaagtagccatgaacaccytgctaagtccgttcttaaggaaattcacggcagttttctttgacgacatactcgtctatagtgcaactcttccagatcaccttcaccacttggaatgcatctttaactccctgtcccaagctyagtatttcctcaagcgttccaaatgtttattcggacaacgtcagctcgattacttagggcacgtcatctccgacaagggtgtgcaaccagacccttctaagattca

SEQ ID NO: 1134 - DNA, 401 bp, Artificial Sequence
  Consensus Reference Sequence
agggacattatgagtatagagtcatgcctttcggcctgtgctacgygccgtcgacgtttcaagtagccatgaacaccytgctaagtccgttcttaaggaaattcacrgcagttttctttgacgacatactcgtctatagtgcaactcttccagatcaccttcaccacttggaatgcatctttaactccctgtcccaagcttagtatttcctcaagcgttccaaatgtttattcggacaacgtcagctcgattacttagggcacgtcatctccgacaagggtgtgcaaccagacccttctaagattcaggccattattgactggcccaaccctcgctccccaaaggatcttcgcactttcctcggtctcactgggttttacaggaaatttgtgaaaggctat

SEQ ID NO: 1135 - DNA, 401 bp, Artificial Sequence
  Consensus Reference Sequence
ccccaaaggatcttcgcactttcctcggtctcactgggttttacaggaaatttgtgaaaggctatgtagccattgcagcaccattgacaaagctcctttgtaaagatgccttcaaatggatactagattcttaggyggcgtttgacaacctgaaaaaggccatgatggtcgcaccggtattagctctccctgatttcacattgccttttkccctagaaacagacgcatccaactatgctatgggagtcgtcctacatcaacacggccaccctatagyattctttagtaagccattctgccagcgcctccaacatgmatctgcgtacgtccgtgagttacacgccatcgtcgccgccgtccgcaaatggcrgaagtatctactgggtcacagattcaccatc

SEQ ID NO: 1136 - DNA, 401 bp, Artificial Sequence
  Consensus Reference Sequence
atggatactagattcttaggyggcgtttgacaacctgaaaaaggccatgatggtcgcaccggtattagctctccctgatttcacaytgccttttkccctagaaacagacgcatccaactatgctatgggagtcgtcctacatcaacacggccaccctatagyattctttagtaagccattctgccagcgcctccaacatgcatctgcgtacgtccgtgagttacacgccatcgtcgccgccgtccgcaaatggcrgaagtatctactgggtcacagattcaccatcttcacagaccatcgcaatctctgtgagctcatgtctcaaactatccagaccccaaaacagtagttctacctggccaagttacttgggtttgactacgacattcagtataaagcag

SEQ ID NO: 1137 - DNA, 401 bp, Artificial Sequence
  Consensus Reference Sequence
cgtccgtgagttacacgccatcgtcgccgccgtccgcaaatggcrgaagtatctactgggtcacagattcaccatcttcacagaccatcgcaatctctgtgagctcatgtctcaaactatccagaccccaaaacagtagttctacctggccaagttacttgggtttgactacgacattcagtataaagcaggaacatcgagcgtggttgctgactctctttcgcgcatagataactcagctcagggacagtacctcgtcctgtctgttcctcaccacgagttcatgcttcaactaaaagaatccttatcagccagctcggagttccaaaagcaacgtgagaccatacaagctgagcctgcagaccatcccgatttctcaatctcaagtgatttcatccttt

SEQ ID NO: 1138 - DNA, 401 bp, Artificial Sequence
  Consensus Reference Sequence
gttcatgcttcaactaaaagaatccttatcagccagctcggagttccaaaagcaacgtgagaccatacaagctgagcctgcagaccatcccgatttctcaatctcaagtgatttcatccttttcaaggatgcaatttggattgatgcccagaacccattcatcccagcactgctacatgagtatcatgctgcccctctcrtgggccatttcggtgtgaagaagatgttccatcgcctccgttccaactttcaatgggccagcatgctcaaagacgttaagacattcgttcgcaactgcagtacatgtcaacaggtaaaatcggtcacgcagaaaagtgctggtctgttgcaacctattccgatacccaccgacatytgggaagatctctccatggatttca

SEQ ID NO: 1139 - DNA, 401 bp, Artificial Sequence
  Consensus Reference Sequence
catgagtatcatgctgcccctctcrygggccatttcggtgtgaagaagatgttccatcgcctccgttccaactttcaatgggccagcatgctcaaagacgttaagacattcgttcgcaactgcagtacatgtcaacaggtaaaatcggtcacgcagaaaagtgctggtctgttgcaacctattccgatacccaccgacatttgggaagatctctccatggatttcatcacacaccttccaagctcccatgggttcacaactatccttgtggttgtagataggttctmtaaaggggttcaccttggcgccctaccttctcactatacggcattcaaaatggctaacctcttcgtcagtatggtatgcaagctgcacgggtttcctcctagcctcattctrac

SEQ ID NO: 1140 - DNA, 401 bp, Artificial Sequence
  Consensus Reference Sequence
aaaytgtgttcctggagtgtacaaacttgttgtgcaggtttcacatcgataagaatgtcaaggccaagtgcaaatctttaatcggtcaaaaaaatgtctagractatgtgatggataactggggtactttggttgattgtccatccgaacaacaatttkctgagtcccttcacaagtttcaaattgcttgttcaccttgatcaatgttcgttgactatgttaagacacatggattatcccacacaaggaaaaatttattacagcctggacgaataaggtcatgcacctaggcaacacaacaacaaacaggtattaaattttttttttctagtcaggattattaataaatggtatttaattgttgtatatttttcatgtttgttgtgtattttaaatgtaag

SEQ ID NO: 1141 - DNA, 401 bp, Artificial Sequence
  Consensus Reference Sequence
tccaaaacttggcttaaggaccgggatcagaatcagaatcggtgtgtcatatagagtgcataaaaagtaaactatattawacaaaaagtgtaacaaatacaaaaaatgatgtcagctataaaacataaaagacatcatcaatgctctgtgcrccgtctttgtcgagccctaacacttccatctgcgctggcaccccccattgcgatcctgagcaatcttgcatgatatcatgtaactttatgcctgcagtgaccatcctaaggttgagcacacaccccaacctttctacgatcgtttcatagccttcrtaatcatcccgtgacagtcatgaaaaacatttattacaaaatttaaaataaataacaattcataaaacattaaacgtgcaacttatcttacca

SEQ ID NO: 1142 - DNA, 401 bp, Artificial Sequence
  Consensus Reference Sequence
ccagcgyggtagctccccaggcatagcccccactctgacccaggtcgcgaaaagcctctagatgcaccacatgaatatttgttgcacttttgttagaaaaaagagtrmaaccgaccaggtgcaggagataagcacgagctrctacaatccatcgtcgtgtctggcatctcgtctcatagatctcccgaacccatgacaggtgtacatatgccccaggcactcatactatctcggctctagcctcctcaccggacacctcaagcaactccatcaacaaaaatattgtctygtccacagaaagagcctcgtagctgtggaaggcgccactaataggcagatggaggagygacgacmcatcatccagtgtgatcrtcaactctccyactggaargtggaaggtg

SEQ ID NO: 1143 - DNA, 401 bp, Artificial Sequence
  Consensus Reference Sequence
gattcttatctttaaggagcaagttagttttaatattctgwtttgctaatatcttgttatctaattagtttatcttttgctatttattgtatcgcyactgagaacaatttgaatyakaatagaataattctatttcytctgcatacgtattgtctttcttctctcctctgttttttttataatttcctcctcaaaaccaataattggtatcgagagccttattcttacgggacctctaccatggaaggtgaarcaagtttttcccacataactctyccaatctttgatggagagaattatgatmtttgggaagtgaaaatgcaatcctacatggagtmtttggatttgtgggatgctgtggaagaggattatgaaatatttccgctgcctgaaaatcccac

SEQ ID NO: 1144 - DNA, 401 bp, Artificial Sequence
  Consensus Reference Sequence
tctgcatacgtattgtctttcttctctcctctgttttttttataatttcctcctcaaaaccaayaattggtatcgagagccttattcttacgggacctctaccatggaaggtgaarcaagtttttcccacataactctyccaatctttgatggagagaattatgatmtttgggaagtgaaaatgcaatcctacatggagtctttggatttgtgggatgctgtggaagaggattatgaaatatttccgctgcctgaaaatcccaccatgrcccaaattaaaaatcacaaggaaagaaagatgaagaaggcaaaggcgagatsatgtttgttcactggtgtttcacaaatgatattcatcakaatcatgactcttaaatcacccaaaacaatttggaattatc

SEQ ID NO: 1145 - DNA, 401 bp, Artificial Sequence
  Consensus Reference Sequence
ttatgatmtttgggaagtgaaaatgcaatcctacatggagtmtttggatttgtgggatgctgtggaagaggattatgaaatatttccgctgcctgaaaatcccaccatgrcccaaattaaaaatcacaaggaaagaaagatgaagaaggcaaaggcgagatsatgtttgttcactggtgtttcacaaatgatattcatcataatcatgactcttaaatcacccaaaacaatttggaattatctgaaagaggaatacgctggagatgatagaatacgaarcatgcaagtgctraatttaaggagggaatttgagcttcaaaggatgcaagagtcagagacaatcaaagaatactcaaacaaattgttgggtattgccaacaagataaagttgttgggaagcg

SEQ ID NO: 1146 - DNA, 401 bp, Artificial Sequence
  Consensus Reference Sequence
ctaatcaagaagaagagkaycaactgtttgtggyyacatgcttcttgagtagtgaatcaagkgaaagttggttgattgatagtggttgtaygaaccacatgamatatgataagactctattcaaggwtttgaagccaactaatgtctcaaaggtcagaattgggaatggtggctatattcctgtaaaaggaaaaggaactgttgcaatttcaacgtgttcagcagaggaggagcatacaaccyatttcactcaagtcacacccacrgaattcaagcacaagasacttgatcattgccatcttgaaagaatgctaaacatgaaaaaaaggaaatatgcaaaaraaaatttgaagaagtttcaaatggaggaatrcaaatctgttagcactccaatgaatcaa

SEQ ID NO: 1147 - DNA, 401 bp, Artificial Sequence
  Consensus Reference Sequence
tcttgagtagtgaatcaagkgaaagttggttgattgatagtggttgtaygaaccacatgamatatgataagactctattcaaggwtttgaagccaactaatgtctcaaaggtcagaattgggaatggtggctatattcctgtaaaaggaaaaggaactrttgcaatttcaacgtgttcagcagaggaggagcatacaacctatttcactcaagtcacacccacrgaattcaagcacaagasacttgatcattgccatcttgaaagaatgctaaacatgaaaaaaaggaaatatgcaaaaraaaatttgaagaagtttcaaatggaggaatrcaaatctgttagcactccaatgaatcaaaakgagaagttcagcaagaaaraaggtgttgataacattgat

SEQ ID NO: 1148 - DNA, 401 bp, Artificial Sequence
  Consensus Reference Sequence
aatatgcaaaaraaaatttgaagaagtttcaaatggaggaatrcaaatctgttagcactccaatgaatcaaaakgagaagttcagcaagaaaraaggtgttgataacattgatgaaggatattatgrgagcttgattggatrtctaatgtatctcacttcaacaaggtcaaayattctatttgctcaaaagaacaaaactggaatttttgttgacaatcaagtagycattgctattgcaaacaatcycgtgtgtcatgaraagactaaacatttcaacatcaagttctattatttgataaagatgcaacaaagtgrtgaagtgaacttaatttattktaagtctaaagatcaaytgrctgacatgtttayaaagtcaytacctatcaacaaayttgaactc

SEQ ID NO: 1149 - DNA, 401 bp, Artificial Sequence
  Consensus Reference Sequence
aggaacatcctcagtcacctgagaaacaccctcatcaaccgcaatatgtacccgttgcctatgggctgatgcagtaggcctacgcctccaggtaacatcaactrcatcatgctcatcctgtctacctctgcctataaccctagctaaagcacracctaaacctcgtgttctaaccatgatctacaaatcatgaagaacacgtatttttttggktcaaataaactattcatataattaaaaacctacatatatttacataaatcttcakccttacgtaataaaccctaatcacactaccctaagctttgttgactaccctaaactaaaccccacacactcaaccactaaacaaaaatataaaaaaataaatataaaaaacaaaaatttaacctaatatataa

SEQ ID NO: 1150 - DNA, 401 bp, Artificial Sequence
  Consensus Reference Sequence
gatgcagtaggcctacgcctccaggtaacatcaactrcatcatgctcatcctgtctacctctgcctataaccctagctaaagcacracctaaacctcgtgttctaaccatgatctacaaatcatgaagaacacrtatttttttggktcaaataaactattcatataattaaaaacctacatatatttacataaatcttcatccttacgtaataaaccctaatcacactaccctaagctttgttgactaccctaaactaaaccccacacactcaaccactaaacaaaaatataaaaaaataaatataaaaaacaaaaatttaacctaatatataatatttaagtaattttttttacataccaccatgcaagcataaatatttctattattacaaaacaaaat

SEQ ID NO: 1151 - DNA, 401 bp, Artificial Sequence
  Consensus Reference Sequence
aaacgtagcaacggcaccacaaaagctttgaaaacgaacggaaatgttaaaaaattataaaccagctaatgatagaagctctttcatattagttttttcaaaagataatttttaaattataaactcacattaacttatagaaaagtttatttatttattttttctttttatattctttttttagtagtaattctaaatacgtttatccaaatagacccttattattaatatatatcaacaatacttacatccaaattatcacttaatcaagccttgaaattattttatataaaataatcagattaattaaccaattacgtgcttggttttcattyataaaatcaatattagtaattatttagaaattttaaaaaattattcagtcatatgtcataatctat

SEQ ID NO: 1152 - DNA, 401 bp, Artificial Sequence
  Consensus Reference Sequence
ttatagaaaagtttatttatttattttttctttttatattctttttttagtagtaattctaaatacrtttatccaaatagacccttattattaatatatatcaacaatacttacatccaaattatcacttaatcaagccttgaaattattttatataaaataatcagattaattaaccaattacgtgcttggttttcatttataaaatcaatattagtaattatttagaaattttaaaaaattattcagtcatatgtcataatctattatatataataagtttattaatttttaaaataaatatrataaagtaattcaaataatatgatttatgattgaaatgatgttcatatcatatgggtataaacattaaactcaattactaatcaactggtatggtc

SEQ ID NO: 1153 - DNA, 401 bp, Artificial Sequence
  Consensus Reference Sequence
aagrtaaggataaaaagaaaaattatccaccttgtcatcattgtggcaaaaaaggtcatgcacctttcaratgttggaggagaccaratgcaawatrtaacaagtgcaacyagataggrcatgaagckgtgatcygcsccaacaaaaatcaccatgatgagggagctcagattgctaatcaagaagaagaggaccaactrtttgtggccacatgcttcttgagtagtgaatcaagtgaaarttggttgattgatagtrgttgtacgaaccacatgacatatgataagactytattcaaagatttgaagccaactartgtctcaaaggttagaattgggaatgrtggctatattcmwrtaaamggaaaaggaactrttgcaatttcracgtgttcaggtatc

SEQ ID NO: 1154 - DNA, 401 bp, Artificial Sequence
  Consensus Reference Sequence
atgagggagctcagattgctaatcaagaagaagaggaccaactrwttgtggccacatgcttcttgagtagtgaatcaagtgaaarttggttgattgatagtrgttgtacgaaccacatgacatatgataagactytattcaaagatttgaagccaactartgtctcaaaggttagaattgggaatgrtggctatattcmwgtaaamggaaaaggaactrttgcaatttcracgtgttcaggtatcaaattaatatcagatgttctttatgtacctaacattgamcaaaacttgctaagtktaggtcaattgattaaaaagggatttaaagtgtcctttgaacatcaacattgctttatctatgacaattttggccgagaagttttaagggttaaaatgaaa

SEQ ID NO: 1155 - DNA, 401 bp, Artificial Sequence
  Consensus Reference Sequence
taaagtgtcctttgaacatcaacattgctttatctatgacaattttggccgagaagttttaagggttaaaatgaaaggtaaaagcttctcatttgatccagtagaggaggagcataacacctatttcactcaagtcacacccacggaactctggcacaagagacttgatcattgtcatcttgaaagaatgctaaacatgagaaaaaggaaatatgcaaaagaaaatttgaaaaartttcaaatggaagaatgcaagtctgttagcacacyaatgaatcaaaakgagaagttcagcaagaaaraagrtrttgataacattgatgaaggatattrtgrgagcttgattgrrtgtctaatgtatctcacttcaacaaggtcaaayattctatttgctcaaaaga

SEQ ID NO: 1156 - DNA, 401 bp, Artificial Sequence
  Consensus Reference Sequence
tatgacaattttggccgagaagttttaagggttaaaatgaaaggtaaaagcttctcatttgatccagtagaggaggagcataacacctatttcactcaagtcacacccacggaactctggcacaagagacttgatcattgtcatcttgaaagaatgctaaacatgaraaaaaggaaatatgcaaaagaaaatttgaaaaagtttcaaatggaagaatgcaagtctgttagcacacyaatgaatcaaaakgagaagttcagcaagaaaraagrtrttgataacattgatgaaggatattrtgrgagcttgattgrrtgtctaatgtatctcacttcaacaaggtcaaayattctatttgctcaaaagaamaaaaytgaaatttttgttgacaatcaagtagc

SEQ ID NO: 1157 - DNA, 401 bp, Artificial Sequence
  Consensus Reference Sequence
tgcagttccaaaagcaaggaggagtgttgaagatatacttttgtaactgcatamtatttkatttttcaatttttaaaataggatttagtaaataagttgattccctataytttaggagtaaggcagttttaatggattagcmtagtcaaataagtggttcttatctttaaggagcaagttagttttaatattmtgttttgttaatatcttgttatctaattagtttatcttttkytatttattgtatcrctgctgaraayaatttgrattagaataraataattctatttcctctgcatayrtattgtctctcttctctcmtctgttttttatagtttcctccacaaaaccaacatgcttttatatgtgtcataatagagcagtagatttccacccctcca

SEQ ID NO: 1158 - DNA, 401 bp, Artificial Sequence
  Consensus Reference Sequence
ttatcacgttggcctggatgctttttgggagtctctttacttttgttycccacatgctgcttttttkatatttctattttgaatttagctcctccagactaaagactcaagagatttaaagagtgatgatatttctaccattaattttaaaaaaaatggattatatttctaaaatgattttaattaaagttagtgatggcgagctttctygctttaaatgtcacctcactttagactagtttcatttctgyttccaaaccgtgtggascagtggtgtatgtttttttctttcttttctgaaattgcttgcaggtttcacaaaacactgatcccttttctttgtgatatktatggatggctrcaaggktactgtgcgtatttaagttcctgtctttaatggt

SEQ ID NO: 1159 - DNA, 401 bp, Artificial Sequence
  Consensus Reference Sequence
ttctaaaatgattttaattaaagttagtgatggcsagctttctygctttaaatgtcacctcactttagactagtttcatttctgyttccaaaccgtgtggascagtggtgtatgtttttttctttcttttctgaaattgcttgcaggtttcacaaaacactgatcccttttctttgtgatatktatggatggctrcaaggttactgtgcgtatttaagttcctgtctttaatggtctgtaagacaagttgtattaaagcakattgtacatgtgtttstatgaacrgtacaaaagttgatttcacaaatctaatttatatttggatatttctattttaaaaataagttagtagtaaaattgcaaatgaatttttttggtgtaatccaaaagttacctaaaaa

SEQ ID NO: 1160 - DNA, 401 bp, Artificial Sequence
  Consensus Reference Sequence
caaaagttacctaaaaatacttaactaagaattagttctaaatttaaaatttaaaatcaatttctcactgtgaaagtaaatagttgaacatttactcaaattcatgttagtttatatttcaacataattttagaaaatcaagcataaaatctaatatayacgattaaaattrtcatagagatgtgttgttttagaaagatttaataacgaattaatcatgatctcataaacaattgatattagtagtagtagtttgtatttcttaatcaagtgttaaacaaatattaaaccaaaacaaaaaaaagtattgaacaaataaaaagaaagaattgaacaaaggacacatgctaattgatccctaataacataatattaaccaattcaagagtttaatatgtcct

SEQ ID NO: 1161 - DNA, 401 bp, Artificial Sequence
  Consensus Reference Sequence
aattaacagataaataaatttatgatatttttttttacttttaaaactaaaattttaattttagtctttaaagacaaacttgtcaacactaaaacataagaagaaaatagttattaaaaaataaaaatgaaagatctttactcatgattcaatgattcgagtcttacccgcgtgaaccctgattctgaatctggaacagyggtctccgtccgatcgacatgtaaggtacgaccacgaatcagtaactgacacrtgtcttatcattcgtgcagatgtcatctgtatatagagcacaacacgggaagacgttaactggytggtactgcgaatattcatccgccactggtgccatctgattggatgaccttgctaccagtcacgggaagagcccatcttgtggt

SEQ ID NO: 1162 - DNA, 401 bp, Artificial Sequence
  Consensus Reference Sequence
aaaaataaaaatgaaagatctttactcatgattcaatgattcgagtcttacccgcgtgaaccctgattctgaatctggaacagyrgtctccgtccgatcgacatgtaaggtacgaccacgaatcagtaactgacacrtgtcttatcattcgtgcagatgtcatctgtatatagagcacaacacgggaagacgttaactggttggtactgcgaatattcatccgccactggtgccatctgattggatgaccttgctaccagtcacgggaagagcccatcttgtggttaggtgttgaasgatgtttggcatascatcattttcattgtccctaattctcaccaatctcacaccyaaaagattttgtyactttgtaacaagggarctgctactaagatttaata

SEQ ID NO: 1163 - DNA, 401 bp, Artificial Sequence
  Consensus Reference Sequence
ttttatttaatatttawraatatttytataatttaaacccatgcattaartataaagtaattttatattattattcactcatatatcatcattaatataatttttaagatattatagatgataaaataataatgaatgaagttttaaattagatttacacttttattatataacttattttttctatttattaastagactttacttttatagccccatttsttgtcytatttctcactcccacatctaagttaactttgttttttcttycttgaatgttgtcacattgtaacaagtggaattrttaagatttttaaaaaagcaawttgtttsaatgataaattaaattttaaacaattttaatattctaatattatatttttatttaatatttttaattt

SEQ ID NO: 1164 - DNA, 401 bp, Artificial Sequence
  Consensus Reference Sequence
actttgttttttcttycttgaatgttgtcacattgtaacaagtggaattrttaagatttttaaaaaagcaawttgtttsaatgataaattaaattttaaacaattttaatattctaatattatatttttatttaatatttttaatttttaagttttcttagtatttaagaatatttattaacaagaccttttatagctattttttttatggaatgactactttttttagtaatgagaattttgcattgatgacgattaacttaagttcaagtgaagcvattgtatgcatgagtgcaaattarcttatttagttkaccarayttttcttataattcacaaaggttgttayaaaaattmaatgtatctaatttaagtatatyaatgcattaaaatctayttat

SEQ ID NO: 1165 - DNA, 401 bp, Artificial Sequence
  Consensus Reference Sequence
actataataatwggtctttaaaatgattaaacacatgcttgagacaacatytttatatgctaayaatgtgggtttgaraaacagcttagaagttagaactagaaggtgttakaatattctcttatkctyttatttattaaacttgacarcaactyytgtcttttcttccttcttcttagttataacrcctatatcatcatgattcctctcattgcaccataaaacaaagaacataaaggccttgcaggtaaattgagatttacccatttcaattttcctctatatgttatattttttttttatcttcattcttatttgaaaattttgaaatctggattcatttttttccttcaaggtttttaaacttttctattttattattgtgggctttaaagtgatta

SEQ ID NO: 1166 - DNA, 401 bp, Artificial Sequence
  Consensus Reference Sequence
aggtttttaaacttttctattttattattgtgggctttaaagtgattatttttctttctaaattgtctctatttctctctgttggatgagaaatattggtcatcatggtgtagaagatttgaattttatgcttcttagttatttgtagtctattagcgtgtttggttttgtgagagtttaattctgttttgtgtggtgtagatttaattgtacattggatataagagagtaacaaaattttaaaattctgttataagtgcctagcctgagtgtaaagggttgttgctttgttttgcttgtataaaaggacatacatacatcttaataacagagtgtgtgttgttttcattctatcatttttctgttgctagtgytattcctagtgtgtaggtgtgcaattc

SEQ ID NO: 1167 - DNA, 401 bp, Artificial Sequence
  Consensus Reference Sequence
tgtagagaaggtgcttaraaccatgccacccaagttcraccatattgtggtagccattgaggaatccaaaaatcttgaagagcttagcctagaggaattgcaaggatctttggaatctcatgagcagagaatgaatgaaaggatcaatgagaagaaaagtgaacaagccttgcaagcatggtctaatccaaagaagcatggtgatagatggaagaaagagaaaactgaagcaaagaacaataaatggaggggaaatcagaacagtgataaggaccacaagaaaagagggggatccaattcccaaaactcttcaaatagaaagaagttmgataaaagaagtattcaatgctttaactrtcaaaagtttgggcactttgctgatgagtgttacagcaaaccma

SEQ ID NO: 1168 - DNA, 401 bp, Artificial Sequence
  Consensus Reference Sequence
caaaaaatagaacatttaaaattgagattgatatgataaaaaagaagtgttttgccactacagtaaatagtgaagagtggttatggcattacagatttggccatttaaattttagagatctgattcagctaaacttaagagaaatggtgctgggtttgcctcagatcaaacctcctagtgaagtatgtgatggttgtttgtagtgtaagcaatcaagaagcactttcaaacaaaatgtaccaatcagggcaaaggagaaacttgaagtgatttactctgatgtgtgtggccctatgcagactgaatctcttggtggaaacagatacttcatatcctttattgatgaattgactaggaaagtatggrtttacctaataagaaggaagagtgatgtctttgaa

SEQ ID NO: 1169 - DNA, 401 bp, Artificial Sequence
  Consensus Reference Sequence
gaagytatgacagaagagcttaaatctattgagaaaaatcaagtgtgggagctggtatctcaaccaaaatcgaagaagcccattgatgtgaagtggatctataagattaagacaaatctagaaggcaaggtggtcaagtataaagctagacttgtggctagaggatttttactgaaagctgggattgactacagagaggtgtttgcaccagttgctagaattgagactattagaacagtagtggcaattgctagcctaaataattggacaatgcaccaactagatgtgaagtgtgctttcttaaatggtcctcttgataaggaggtctatgtgacacagccacctggattctctatagctrgccaagagtcaaaggttcttaaattgagaaaagctcttta

SEQ ID NO: 1170 - DNA, 401 bp, Artificial Sequence
  Consensus Reference Sequence
cagcaactcagaggaattagtgggatatactgatgcagattggggaggagacagagatgacagaaagagtactacaggttacatattcatgtatggtrcagcaccaatatcgtggtgttctaagaagcaatccatagtggctttatcaacatgtgaagctgagtatgttgcagctgcaatgagtgcttgccaagctgtctggttggacacattattacaggaattaaaaatcaaggagagtgatggastgaagctttttgtggataataagtcakctataagcttgtcaaagaatccaacctctcatggtagaagcaaacacatagaaacaagrtttcactatcwtagggatcaagtgaacaaakagaaattgaaagtggagtattgctgcacatttgatc

SEQ ID NO: 1171 - DNA, 401 bp, Artificial Sequence
  Consensus Reference Sequence
attgaaagtggagtattgctgcacatttgatcaacttgctgatattttaaccaaacccctcaaaggggagaggtttaaaatgttaagggacagaattggcttgatgaacttaggagatcagaattaagggagggtgtgagagtttaattctgttttgtgtggkgtagatttaattgtacattggatataagagagtaacagaattttaaaattctgttataagtgcctagcctgagtgtaaagggttgttgctttgttttgcttgtataaaaggacatgcatacatyttaataatagagtgtgtgttgttttcattctatcatttttctgttgctagtgctattcctagtgtgtaggtgtgtaattctttgtttaaaaacagtgagtgatacgcgagtgaa

SEQ ID NO: 1172 - DNA, 401 bp, Artificial Sequence
  Consensus Reference Sequence
tcttgttttgttcttyttggtcatgaatcgtttatttttaagaactctawaaacgactagactacctgagagaaatstaattgatgtgytaaatactttgttttttaatccagtcctgtttaaatatgatcaaaactcacctaatgccttatggtttcgggttaagcaccaagayggattactccacagtacatgtggtagccctgcctatgttgctccggaagtgataaacagaaggggttatgatggagccaaagctgatatatggtcatgtggggtgatcttgtatgttctattggcaggggagasttcaaatttcctaactggwttgcaccagatgtaygcagattgctgtcgaaaatcwtggaaagytcttggttcaaaagggggytagagaagcc

SEQ ID NO: 1173 - DNA, 401 bp, Artificial Sequence
  Consensus Reference Sequence
ttgctccggaagtgataaacagaaggggttatgatggagccaaagctgatatatggtcatgtggggtgatcttgtatgttctattggcaggggagasttcaaatttcctaactggwttgcaccagatgtaygcagattgctgtcgaaaatcwtggaaagytcttggttcaaaagggggytagagaagcctaccattactcggaackaagaccaagaactggctcctctkgatgcattatttgtgaaaaaattgttttagtatgtaaaaaaatctcatatcacwttaaactttacagttaagactaagagaaatttataaatatttgatttctcaatctagcaagactttatttaataataacaaaatcatgacagaaattcaaagcgaaatatcaaagaat

SEQ ID NO: 1174 - DNA, 401 bp, Artificial Sequence
  Consensus Reference Sequence
cttttaacacttaatttttttttattattaaattaattttatatctttrgatattttatttattattattaattattaaaagaaagtgcakagagtattgttagcatttctattattattaatctgaaattgaacaatgtatgtattcaacacaacatawctatgtatgtatttaatttgttttgttattgttttacgcaggtatttggaggtgactgaaatcgttagtgtgycctrgctaaaaatcctgggcaggatcaaaactrsratgttgtccccaaatacattgtacggggcataccttgtgtttaaagaaagcagtgatggtgcctacgggttcaagaacrtgcctgttgaggtgtccattggggttatcsgagaggttacagattcaagaatta

SEQ ID NO: 1175 - DNA, 401 bp, Artificial Sequence
  Consensus Reference Sequence
  misc_feature 143, 333: n = A,T,C or G
acttaaggaatctagaataagacctccacaaaaagcttggttcgaggagggatagtaagaaccatccgtcttaactttaaaagcccctgcaggaggaggtactcgtgcttartcgccwactaacyctccatgcacccattaantgttccttcttcttaggcatagtctagtgtagtatgcgaccaactagggtatgatgagtatgttggtgtagtagtgccataaggcgwggatatttatgctttcgasgctttgtgttgtaygtacaatgtatctcatggtrgcgtatctttgtttcrtagttggataktggttgcataacttacaaaaaantaacacatttttataagcaaattaatggagagttttcttataaaatggatcgtatacattatgttagt

SEQ ID NO: 1176 - DNA, 401 bp, Artificial Sequence
  Consensus Reference Sequence
  misc_feature 114, 304: n = A,T,C or G
aaaaagcttggttcgaggagggatagtaagaaccatccgtcttaactttaaaagcccctgcaggaggaggtactcgtgcttartcgccwactaacyctccatgcacccattaantgttccttcttcttaggcatagtctagtgtagtatgcgaccaactagggtatgatgastatgttggtgtagtagtgccataaggcgtggatatttatgctttcgasgctttgtgttgtaygtacaatgtatctcatggtrgcgtatctttgtttcrtagttggataktggttgcataacttacaaaaaantaacacatttttataagcaaattaatggagagttttcttataaaatggatcgtatacattatgttagtataaagtaattacaggttggtaacttaat

SEQ ID NO: 1177 - DNA, 401 bp, Artificial Sequence
  Consensus Reference Sequence
gcccgcctataaaccatartgcaagcttgatccttgatatatatatatatatatatatatatatatatatatatatatatatatatatatatatatagagagagagagagagagagagagagagagagagagagagagagagagagagagagagagaatcttctttcaccaattaatgatgccatgccaacacgtccaaatttttttgggactacactgtaacggtatgttttctatatacaattacaatgtattcccagctagctrggatatgtctgcaagttctttaatattttatgtttasattttcaagtwggtttttgtaaacaaaatctgaccagatcaaaatcaaatrgaactgcccttatatcgtggttaattttgagcttctgcttccyacc

SEQ ID NO: 1178 - DNA, 401 bp, Artificial Sequence
  Consensus Reference Sequence
tcattatgtatggtaaatttattaacttttaaaataattataataaaataattcaaaatatatgatttatgattaaatgattatrtaaaattaatttatacaatatgtgacattaaactcaattactaatcaactcatggtggtcaataagcacataaagacgtagcsaagggacaaacaaaataaattaaaaacaatcaccacaactyttacgatcttayaaaagtcttcaaaccctaagcgtaaagtcctcgtcagtaatgcttgtcatgttttatctttcacaataaacgccggcaaaaatrtarctaaattaataaatcatgtttttctcaataattagcctctgcataataacttgrtgaataacyaaattaataataattatatacgtataattg

SEQ ID NO: 1179 - DNA, 401 bp, Artificial Sequence
  Consensus Reference Sequence
cgtagcsaagggacaaacaaaataaattaaaaacaatcamcacaactyttacgatcttayaaaagtcttcaaaccctaagcgtaaagtcctcgtcagtaatgcttgtcatgttttatctttcacaataaacgccggcaaaaatrtarctaaattaataaatcatgtttttctcaataattagcctctgcataataacttggtgaataacyaaattaataataattatatacgtataattggcaaatcagcagaactttgcactcgacaaactgcascggaaaaaaaaaagttagatgctctctgcctagattctcttgattgcttggggaaacactcctagtggacttcggttccaaaggccaggwaataattagtataatcgtgtttttaatttttattt

SEQ ID NO: 1180 - DNA, 401 bp, Artificial Sequence
  Consensus Reference Sequence
tttttctcaataattagcctctgcataataacttgrtgaataacyaaattaataataattatatacgtataattggcaaatcagcagaactttgcactcgacaaactgcascggaaaaaaaaaagttagatgctctctgcctagattctcttgattgcttggggaaacactcctagtggacttcggttccaaaggccaggtaataattagtataatcgtgtttttaatttttatttctttaaagtagttkattacattrgattagcggataaaaattaaaaatrtaatatacaaaaacacaaaatacacttaagcattgctccccyaaaattttcaagatttatatatatgtcctgcatattkgtgttttttaatttgcaatctaattttaaatttttaat

SEQ ID NO: 1181 - DNA, 401 bp, Artificial Sequence
  Consensus Reference Sequence
ttagatgctctctgcctagattctcttgattgcttggggaaacactcctagtggacttcggttccaaaggccaggwaataattagtataatcgtgtttttaatttttatttctttaaagtagttkattacattrgattagcggataaaaattaaaaatrtaatatacaaaaacacaaaatacacttaagcattgctcccctaaaattttcaagatttatatatatgtcctgcatattkgtgttttttaatttgcaatctaattttaaatttttaatgtttaaagcttttgttcttttagaatcccagataatctcaactagcacagtgctcttattcacaggtatgtatacatatatgtgaagtgaccaattctttaaaaaaaaattatgataatcaaata

SEQ ID NO: 1182 - DNA, 401 bp, Artificial Sequence
  Consensus Reference Sequence
ggaaacactcctagtggacttcggttccaaaggccaggwaataattagtataatcgtgtttttaatttttatttctttaaagtagttkattacattrgattagcggataaaaattaaaaatrtaatatacaaaaacacaaaatacacttaagcattgctccccyaaaattttcaagatttatatatatgtcctgcatatttgtgttttttaatttgcaatctaattttaaatttttaatgtttaaagcttttgttcttttagaatcccagataatctcaactagcacagtgctcttattcacaggtatgtatacatatatgtgaagtgaccaattctttaaaaaaaaattatgataatcaaatatagtgacatrtaacatagaagtaagtataatatagwa

SEQ ID NO: 1183 - DNA, 401 bp, Artificial Sequence
  Consensus Reference Sequence
tkgtgttttttaatttgcaatctaattttaaatttttaatgtttaaagcttttgttcttttagaatcccagataatctcaactagcacagtgctcttattcacaggtatgtatacatatatgtgaagtgaccaattctttaaaaaaaaattatgataatcaaatatagtgacatrtaacatagaagtaagtataatatagtaatataaaaagtattgtttcttgatgaaycaaatatgaaaattgttttgtttatagataatttcaagaaagaaatgagattgatcattgatagtaccattyttatttgtgatcaataggaaaaaatratctacaatttttttattttgtttttagcaatgtctaagaagtattttcacttgtacaccttttcatccttca

SEQ ID NO: 1184 - DNA, 401 bp, Artificial Sequence
  Consensus Reference Sequence
araaataartttcccryrgtcattttcactctggcctcaataatmttaaggadaaattaagttagaatataacaayactgatgtgtaacatttttycggathattatatttaagtatttatcaatgttgttacttagtacctgyatcgttacttcttcgaaacatatatacaaggtcaatttccacgttgcctttgatratttgttgattctctgtagattcagtaacatatatacaaggtcaatttccatttcagaatgaattggatttagtaaaacgtaaaagkagaaagacatgaaatgaaacatatccttgacagaaatagttttstagttggttagacttrgaagatacctgttgrtcatccttggtggctaaatccatctatcrtcaaccykaat

SEQ ID NO: 1185 - DNA, 401 bp, Artificial Sequence
  Consensus Reference Sequence
ttgacagaaatagttttstagttggttagacttrgaagatacctgttgrtcatccttggtggctaaatccatctatcrtcaaccykaatgccagggatgtggsaaattttaggccaaatttgagggtgcttcatgcggcatcktttttccagcaaaggacatctctytatggttaattttattagagagwcaggaagcctttctcccaccatattytccagcaaaggacaactchbtatggttaattbttgcagggatgygagatggagaagccccgtgcagtccaacatctccagatttgacaagtcmywtagatacagagamgtaagggagggaggcagcaaaccctccttagggaakgacttgatrccatcacatsgaccccmaacastgagatgrgt

SEQ ID NO: 1186 - DNA, 401 bp, Artificial Sequence
  Consensus Reference Sequence
agggatgygagatggagaagccccgtgcagtccaacatctccagatttgacaagtcmywtagatacagagamgtaagggagggaggcagcaaaccctccttagggaakgacttgatrccatcacatsgaccccmaacastgagatgrgtaagcatgcccatggatggccatgctaggccgctcagtagtttckcacaattgwmaatcbvaactgttctcaggttaggtggcatacccccttytggaaasgactcaatttctgggcagttggatatgwsgagatrttctaactttgggagaagastactcatctcatcaggyaacgacttcaacttgtcagagcccgcaacgatgaacttaagcaagttgggcgcaggcaatccttctccccagaatgatac

SEQ ID NO: 1187 - DNA, 401 bp, Artificial Sequence
  Consensus Reference Sequence
aaygcatgcagtgctactttattgcttttamktatcwccaaactttgaatggcsggagccgttgggagagaagagacaagcagctcgcaattwmtwataymaagtgttktcagagcaggaaggtgattcggcaaacttccctctagtttggggcagtcacktatkthaagactkttaagcacaggaaaagcttctgaatcgaaggaactccacacctcccaacaaggcatgtgatsaatggycagagattcaagggagggaaagggcatccgacawtcttcattcttgtagaaacctgcatcaatagtcttcagcctattcaatcbtgmaatttcaaggwccttgagagaaggtagttgkccwagtgaaggaagcatactacagttgtcacaatcacttaa

SEQ ID NO: 1188 - DNA, 401 bp, Artificial Sequence
  Consensus Reference Sequence
tgacaagttctccactgcactctctttcaaatcaagwytctccttgagttttaaatgagactcwagtgtgacaactatgtyytccaacttactaacratcttcctatcggraaagcgagraaamaagtttcttaccttcttttgggtggcagctttggtgaaaacatggtcgagtaartcatcggcytcatagacagcatgtttgagatcatygagccagtstttgacattggtgtttgtgatctgtttcttctcrgcatcatcaagcacagctccaaccactctgakagtggwytccaacttttgaagcaacttcttgctaagyttctttccamggatcaagycaacaaactyaggtgaasccagcctgtcgaaaascacatcaagraaagcagagagaa

SEQ ID NO: 1189 - DNA, 401 bp, Artificial Sequence
  Consensus Reference Sequence
  misc_feature 113: n = A,T,C or G
tgaacaaataaaaagagaaagaattgaacaaargrcacatgctaatkgatccctaagaacataatattaatgaattaaagwgttcaatatrtccttatytgtacataaaaaanaaaagaagtatgtagaaagaaaagtgtgtgattttttactaaataaaatcaataaataatagatactaatatagtaaagaatattgtgaagaagttktcataataataataataataataataataytcwagagggagtgattaaagtaattcctttgaaatggtgtcatcaaaattatcattcaatttaactatatttttatatgttgtatatctattataattatttgatgtatatttttatraaatttcttggtttctgaycatccttcatatcttatctataca

SEQ ID NO: 1190 - DNA, 401 bp, Artificial Sequence
  Consensus Reference Sequence
aatataattagatataactctaataataaaaacttcattatttatttgttaaagtcttgaagatatttatcctcaaacttattttttctcctcaaaattatttttatcttttgtactaccaaacaaaactttacaagagtaatggcttagtagaattcaactaagtatcatctcttctcctaaatatttgttagagtcttgttaataaaataaatcttcttttaattttttaatcaatactctcaaaacaaagatgaaacacactttytaaaagtatthcattttatttattttatgaataaggagtattaaagtgtatttcactaaaaaaatcaaaaatawaatacattacattttttaataagatgaagtaaaagaagtgaaaaaatatatatatttaa

SEQ ID NO: 1191 - DNA, 401 bp, Artificial Sequence
  Consensus Reference Sequence
agagcacaacgcgggaaggcattaactggttggtactgcgcatattcatccaccacgtggcaccatctgattggatgaccttgctactagtcabgggaagarcccgccttstggttaggtsttgaaggatgtttggcatagcatcattttcattgtccctaattcycaccaatctcacacccaaaagattttgtyactttgtaacaagggagctgttactaagmtttaataaaggaccaaaaagttttaatgataaactatacagtatttttaacaattttaatatactattattatatttttatttaatatttaaaaatatttctataatttaaacccwtgcattaagtataaagctagtaattttatattattattcactcatatatcatcattaatat

SEQ ID NO: 1192 - DNA, 401 bp, Artificial Sequence
  Consensus Reference Sequence
atttttaagataattattrtagttattataaatsataaaataatattgaatgaagttttaaatttgatttacacttttattatatwacttattttttctatttatyaacaagacattacttttatagcaccatttgttgtcctatttcycactcccacatctaagttaactttgtttttttttccttgaatgttttgtcatattgtaacaagtggaattgttaagatttwaaaaaaagaaaattgtttgaatgaaattaaatttcaaacaattttaatattctaatattatattttttatttaayatttttaagttttaagttttcttagtatttaagaatatttattaacaagaccttttatggctatttttttattgaatgactatttttttttagtaa

SEQ ID NO: 1193 - DNA, 401 bp, Artificial Sequence; identical to SEQ ID NO: 637
  Consensus Reference Sequence

SEQ ID NO: 1194 - DNA, 401 bp, Artificial Sequence
  Consensus Reference Sequence
taattgayaatccaagaaatcaatgacatarccttctttctaaaacaattctctaaaattattaattatcatctaatcaactacyaacagtattagtgtgctttctgccatctgatgattgattgtttgattaaattttatttcttctgcataatgtgtggccatctytggtttygatttattcttgayttttkacaatcttacatttctgtcatacttgtttagttcttcttggtcatgaattgtttatttttaagaactctaaaaacaactagagtacctgagagaaatgtaattgatgcgctaaatactttgtttttwaatccagtcctgtttaaatatgatcaaaaytcacctaatgccttrtggttttgggattgttaaaaaatgacatcagaaac

SEQ ID NO: 1195 - DNA, 401 bp, Artificial Sequence
  Consensus Reference Sequence
ccatctgagctatccttgttcaaccttgatgacattggatgtttagtccactgtccatatctattttttgctcragcractgaggtgccaagaaatctcagccattgtgcaatatccaaacacaatgatygtgaagacggttgagctttgaattwcttgagtagcagtttcctgcttctggccgcgtgattgcctgtactgagtgctattgatattagcattggttttcaccasaaagtatttctagaaatggagcaaaaaggaggtgtgcytatgcaaygatatgaagtggggagattattaggccaaggaacctttgcgaaagtctaccatgctaggaacatcayaactggcatgagtttaagtttatatattaaagataaaataagaagaaaatwtaa

SEQ ID NO: 1196 - DNA, 401 bp, Artificial Sequence
  Consensus Reference Sequence
gaagtggggagattattaggccaaggaacctttgcgaaagtctaccatgctaggaacatcayaactggcatgagtttaagtttatatattaaagataaaataagaagaaaatwtaaaatgttagaagcwggcatttttwaaaatattaatttaagtaatattttaaaaaatgttaaaaactactaaaaaaacttgtttattaaatagtcaaacaagttttttaactagtaaagaaagttagaagtcatttgaaatgtgttcacaaacatatctttaaacaagattgaaaaaaaaactaggcaatatccttaagcaaccattaarytaggactaagaaactaaaaattaatttttttttattaaaaaatacaacagaacatttctttacaaatctaactaaa

SEQ ID NO: 1197 - DNA, 401 bp, Artificial Sequence
  Consensus Reference Sequence
  misc_feature 317, 320, 321: n = A,T,C or G
tttactaaataaaaccaataarataaataaataatagataytaatatactatattaagttttgacatgcagatatccccatgatwttatatttatattaaaaaaataggcttccadgtatsaaaaatagractcasagagaakgggagtggcggatacaagccagatcttgcataatggtaattaggaaaaacaaacccagaccccctccytttcctaaggcattacttaktctcagcctctacactctccttacaagctatccattccattatgycaacctatgttccttttccacttcagctagtgcaacttgtncgnntgattcyttctgctgtcatacacaagcaggtcttgttwctgaggcccatttgtcctttctttttctattcccccacyccc

SEQ ID NO: 1198 - DNA, 401 bp, Artificial Sequence
  Consensus Reference Sequence
  misc_feature 120, 123, 124: n = A,T,C or G
ccaraccccctccytttcctaaggcattacttaktctcagcctctacactctccttacaagctatccattccattatgycaacctatgttccttttccacttcagctagtgcaacttgtncgnntgattcyttctgctgtcatacacaagcaggtcttgttwctgaggcccatttgtcctttctttttctattcccccactccctcttttccctatccttttatataccttcattatggacctatcaagttctaaccagraaaattycaaaaayatttctaacccaaatctcsaaattcacatgatgtcaaatcagaaaaamaaactaaataaataagaaaatgtsattaaaaataatatataacactacagagaaaaaaatcaraaaattawttttccat

SEQ ID NO: 1199 - DNA, 401 bp, Artificial Sequence
  Consensus Reference Sequence
tgaatccactkattttatttgttataatttrcacccactgacttagggtcttggatccgccactgtctggaagaatgatgcttgtcgtgtaggrgtaracaaacttaaccatttcctgatattytgtagcacaaaaagayaarttygattattragaaatyartataaataatacwatgtaataayagcatcaatcaatggaatatacaaytgttccttcccttattcttttctctatggagrccctggtcctyraaaaccagcttctatcttcttycctatcaacaagaatatagcatatataattatgtatgataattttaagaaaataaacaacactaatagaatggtaaaatasaaaaaaaaaatcatagctgcayttccagaagcatcttatggaa

SEQ ID NO: 1200 - DNA, 401 bp, Artificial Sequence
  Consensus Reference Sequence
tacagtggactgyagcaacaattttctcrctagcaaaagtaagggattaatgaattgtttatggtatgacagttagtcatcatgaagggactactaacataaacttaattgcacgacmatatttacgggatatgattgaacattttgatacaacataaagaccttgacttgtaaaaattgaaggbgcgtgcttcaagcacgaataaaaagctctcattcwgacctaaggagacatgttatacaatacacttcacgtgagtgytctagattgaagtagcctccattttgaggaagcttttttcygraacwtgtttgttgtctttgtattgttctttagaattaaagtctattatgccagtagtgcatatagtttrtctcaagtaaatcactaawgattraay

SEQ ID NO: 1201 - DNA, 401 bp, Artificial Sequence
  Consensus Reference Sequence
tcgccttgkrtttctgtatggtgccatcarggttgagctttgtcttatrgacccacttaaccccaatgatatcttttccatggggacratttrctaactcccatgtgttrtttttctcgatcatytgtatctcttcttccattgccttsacccatacttcctgctttgacgmttcttcaaagcttccaggttcaagtatggccaagttacaggtttcatatatgtccaccaaagatcttactcgtyttggagtagactctggcgatgatagttcttgatcttgttgttgtggtggaggtgaaggtggttcacytgggtyttcatcctcagcttcttcttgaggtagttgarcgggtataagaacattcttctccactttttcttcatctcaattccaagaa

SEQ ID NO: 1202 - DNA, 401 bp, Artificial Sequence
  Consensus Reference Sequence
  misc_feature 175: n = A,T,C or G
cgacacctcgcgcttaacgtgttcagatcgtgygcttagygsgtgctgcaggcttagygtgtgattctattggattgcgcgcttagcgtgtgcctcgcgcttagtgcacgtaacraatcctgcatcttcgtacttaacgcctcgcttagcgcctgtgcttgcttgcatgcttagngcgcyaagcgcgcgtgttgagcggagcctsctttagattttcttctttttcttcaatttttgttgccttttkgcttgttgtaccttcarttttgatatccgtggctagaaattcaaacttaatwagttttctaacatttaatcacaaataactrctaaataattaattttaagccaaaatttgactgattccctactattaattcamwattatttagcaattatca

SEQ ID NO: 1203 - DNA, 401 bp, Artificial Sequence
  Consensus Reference Sequence
  misc_feature 47: n = A,T,C or G
cgtacttaacgcctcgcttagcgcctgtgcttgcttgcatgcttagngcgcyaagcgcgcgtgttgagcggascctsctttagattttcttctttttcttcaatttttgttgccttttkgcttgttgtaccttcarttttgatatccgtggctagaaattcaaacttaatwagttttctaacatttaatcacaaataactgctaaataattaattttaagccaaaatttgactgattccctactattaattcamwattatttagcaattatcaacaagtagtaatgacttgtatttcttaaccaaatggtctagagtttgaattttggttaacccttatgcatagaatwaaagaaagaamacatgctaattgatctctaagaacataatattaatgaatta

SEQ ID NO: 1204 - DNA, 401 bp, Artificial Sequence
  Consensus Reference Sequence
gcgcgcgtgttgagcggascctsctttagattttcttctttttcttcaatttttgttgccttttkgcttgttgtaccttcarttttgatatccgtggctagaaattcaaacttaatwagttttctaacatttaatcacaaataactrctaaataattaattttaagccaaaatttgactgattccctactattaattcamtattatttagcaattatcaacaagtagtaatgacttgtatttcttaaccaaatggtctagagtttgaattttggttaacccttatgcatagaatwaaagaaagaamacatgctaattgatctctaagaacataatattaatgaattaaagatttcaatgtccttacatatatgtcaaagatgtatgcagaaagaaaagtgr

SEQ ID NO: 1205 - DNA, 401 bp, Artificial Sequence
  Consensus Reference Sequence
  misc_feature 392: n = A,T,C or G
caattagaaaacaagaccaagagagcaatwacaaggcccacttacctcaaggattaggtgtgaarcaakcaggtgcaccatatctggaagaatgatgctggtcrtgtaggggtagacaaacttaaycatttcctgatattytgtagcacaaaaagacaaattcgattattgagaaatcagtataaataatactatgtaattacagcatcaatcaatggaatatacaactgttccttcccttattcttttctatgtggaggccctggtcctcvaaaaccagcttctatcttcttccctatcaacaagtatatagcatatataattatgtatgataattttaagaaaataaacarcactaatataaaatatatagaatggtaaaatacaaaaanaaaaaacaa

SEQ ID NO: 1206 - DNA, 401 bp, Artificial Sequence
  Consensus Reference Sequence
ggtcatatgatgctatatagaatgcaacaacttctatcattttttgctctagtggtaaaattyaatttgaattcttagattttatttgcacagaaaaaaaaagaggagtttttaggagttcttctcctaaaattcaaccttcatcaygaaatwctcttgaataagaataatggtarttagtggcggacctgcatatatatgagagtgtgcaggtgcaccccctgacttggtaaaattattattaagtattttaaattttttttattttgctccctctaatcctatatatttgaacccamkgtcctatatattttaaaattgtctcaattaactcagggtcttagatccgccactaatgatagttttagtgcacmggggttcttgagctcaatcaagaatcc

SEQ ID NO: 1207 - DNA, 401 bp, Artificial Sequence
  Consensus Reference Sequence
ggtttttcgabgagctygagaaactatttgccatcgacatgcaagctcagatggcaagagatcakaggakacattgcttaaggttaggagaatacttagggttgttgagaaaaygtgcttcgaccctggggaggcaattgaaaacacgytgttaatgtttttgacgtgkatttctgtctttgytrtgaagctaataagggtagcttttacgttttcttccactaaacaggagcagwtttcacttgataaacaattgaagaggaaaaaasrctacttgctctctgccaggagtctcacagttttwtggggagagggagacactcctaggtattgggggtgggctggggtcaggtaattatttcttgttttctrattaattagttaattgtgccaatattttt

SEQ ID NO: 1208 - DNA, 401 bp, Artificial Sequence
  Consensus Reference Sequence
gacatgcaagctcagatggcaagagatcakaggakacattgcttaaggttaggagaatacttagggttgttgagaaaaygtgcttcgaccctggggaggcaattgaaaacacgytgttaatgtttttgacgtgkatttctgtctttgytrtgaagctaataagggyagcttttacgttttcttccactaaacaggagcagttttcacttgataaacaattgaagaggaaaaaasrctacttgctctctgccaggagtctcacagttttwtggggagagggagacactcctaggtattgggggtgggctggggtcaggtaattatttcttgttttctrattaattagttaattgtgccaatatttttatttggtttaattactccgttacttgaattcgtat

SEQ ID NO: 1209 - DNA, 401 bp, Artificial Sequence
  Consensus Reference Sequence
aattgttgtaattgaaaagtagtttgataggtagaaggaggcacaggggtaacaaacacacgggttccatgctcaactarcagaaaatgtrgtgcaaacmrcaagcctgcttcaaggacttgcgtggtgcacgtatgaagaatagtggcgtgaatggragctaacctggattgtgaaaatggaatacaaattgcaaaathgtcaatgatttytagaatatttcctttatacaaaatgacaaattctattattagggaagtggtataaataaaagcatttgtaaaccattgagggatatgaatgaacaaaatacaagcttcctttccttcrgtgcctttttctctcttcttcttccttgcattctggaggtgctagtcccgaatccagcaatttccctgygt

SEQ ID NO: 1210 - DNA, 401 bp, Artificial Sequence
  Consensus Reference Sequence
ttgaaaagtagtttgataggtagaaggaggcacaggggtaacaaacacacgggttccatgctcaactarcagaaaatgtrgtgcaaacmrcaagcctgcttcaaggacttgcgtggtgcacgtatgaagaatagtggcgtgaatggragctaacctggattgtgaaaatggaatacaaattgcaaaathrtcaatgatttttagaatatttcctttatacaaaatgacaaattctattattagggaagtggtataaataaaagcatttgtaaaccattgagggatatgaatgaacaaaatacaagcttcctttccttcrgtgcctttttctctcttcttcttccttgcattctggaggtgctagtcccgaatccagcaatttccctgygtttgcacrtaac

SEQ ID NO: 1211 - DNA, 401 bp, Artificial Sequence
  Consensus Reference Sequence
  misc_feature 239, 240: n = A,T,C or G
caacayggcataattaaaagttagyagacstctgyaattttctaaatcgtagtcattgactcagatttacactaagagtgyrtttggatagataagtttaactrataaaagtaatttatcagakaatttgaatttctgtaatygaaaattcattstttagatattttttgtgaaaaatttaaatttttggaattttaaaatagaattttaaataactaaaaatgtgaaatttmaatttnntcctaaaakgtgagaaattgaaattmtctttttataaaagaattttctaaaacgttcrcktatttacttactaacctttatcattttttctacgtgaaaawtttcaaagttctgttctcgaactagagactctaccctcacaccgataattcttttcttca

SEQ ID NO: 1212 - DNA, 401 bp, Artificial Sequence
  Consensus Reference Sequence
  misc_feature 329: n = A,T,C or G
ttwctaaatataatataatatayttaatcattttaagatcattagaaactcytaatrtaaaactaattcaaatatttcataaaaattattattcttcaaagtatttatcatcaccagtattctttcatatgataagttatcgcccgattatgcaattaaaggactaaaaatatacataaattagataatttagtagtwagtatgtttttgtcttacaagcaaaatataatattaaacatctataacaattcatcttacaaragtgttacttttcttttggctaaaaataattatcgtcatacrttattttatataaataaaaaaataanttttttttataaaaktaactttatattatcattaatttatttttaaattttatagttcatmattcatatata

SEQ ID NO: 1213 - DNA, 401 bp, Artificial Sequence
  Consensus Reference Sequence
  misc_feature 227: n = A,T,C or G
atttatcatcaccagtattctttcatatgataagttatcgcccgattatgcaattaaaggactaaaaatatacataaattagataatttagtagtwagwatgtttttgtcttacaagcaaaatataatattaaacatctataacaattcatcttacaaragtgttacttttcttttggctaaaaataattatcgtcatacgttattttatataaataaaaaaataanttttttttataaaaktaactttatattatcattaatttatttttaaattttatagttcatmattcatatataagaaatataartaaaaaaattaattttatattaaaaagtcaaaataacaattattttaraattattattktttacacgacaattataatggagcagatgaca

SEQ ID NO: 1214 - DNA, 401 bp, Artificial Sequence
  Consensus Reference Sequence
  misc_feature 118: n = A,T,C or G
cttacaagcaaaatataatattaaacatctataacaattcatcttacaaragtgttacttttcttttggctaaaaataattatcgtcatacrttattttatataaataaaaaaataanttttttttataaaaktaactttatattatcattaatttatttttaaattttatagttcatmattcatatataagaaatataagtaaaaaaattaattttatattaaaaagtcaaaataacaattattttaraattattattktttacacgacaattataatggagcagatgacataataataattaatwtaagtgatattagagattcatataataattaattagttttaagaaatatttaatttcatttttttcatttaatttaattaatttatatttaaaa

SEQ ID NO: 1215 - DNA, 401 bp, Artificial Sequence
  Consensus Reference Sequence
attctcatataattttataaatacrcgcccgaatttttttatyaaatatatgtttcgtgcataayaagagagttgaataagtattgagtgtcattgttattctttcaaaaattagaattcaactaccatcttgacatcttaaagccacctcacttagtcgtagmacctggcataatatttaatttataagtaatgttttctrtcagtattctaattaataagaattctagcttataaaaatattggatttaataaataacatayaaatttaaatattttaacycaataatttaattgaaatcgtatacaaatgactcaaatcaactcattcaattataattgaattaagtcattataatwgaattaagtcataggtatgatgaaactcaatccaaacttac

SEQ ID NO: 1216 - DNA, 401 bp, Artificial Sequence
  Consensus Reference Sequence
taatttaattgaaatcgtatacaaatgactcaaatcaactcattcaattataattgaattaagtcattataatwgaattaagtcataggtatgatgaaactcaatccaaacttacctgcatacacctctatgttggctggctgaatttttaaaacaaaattktcttgtattttaaaagtggatttgtgcaattcgtgcaatgaagkttttgtgttaaataattgatgaaaaagaattcgtggcgaattatcttttgtcaaatmtgcccaaggtgtgatcgattttgtcaaaacccattttatatttgtaattaatattttattttaaaatttattgttacagttcgtacgtatacagkttagtgatatagtttacagttcgtgtgtttcatrccaatatat

SEQ ID NO: 1217 - DNA, 401 bp, Artificial Sequence
  Consensus Reference Sequence
taattgaaatcgtatacaaatgactcaaatcaactcattcaattataattgaattaagtcattataatwgaattaagtcataggtatgatgaaactcaatccaaacttacctgcatacacctctatgttggctggctgaatttttaaaacaaaattktcttgtattttaaaagtggatttgtgcaattcgtgcaakgaagtttttgtgttaaataattgatgaaaaagaattcgtggcgaattatcttttgtcaaatmtgcccaaggtgtgatcgattttgtcaaaacccattttatatttgtaattaatattttattttaaaatttattgttacagttcgtacgtatacagkttagtgatatagtttacagttcgtgtgtttcatrccaatatatmattt

SEQ ID NO: 1218 - DNA, 401 bp, Artificial Sequence
  Consensus Reference Sequence
gtcattataatwgaattaagtcataggtatgatgaaactcaatccaaacttacctgcatacacctctatgttggctggctgaatttttaaaacaaaattktcttgtattttaaaagtggatttgtgcaattcgtgcaakgaagkttttgtgttaaataattgatgaaaaagaattcgtggcgaattatcttttgtcaaatctgcccaaggtgtgatcgattttgtcaaaacccattttatatttgtaattaatattttattttaaaatttattgttacagttcgtacgtatacagkttagtgatatagtttacagttcgtgtgtttcatrccaatatatmattttcktaaataaattgcacgaatcctttgcatcactcatatatacaagtgctgcaactt

SEQ ID NO: 1219 - DNA, 401 bp, Artificial Sequence
  Consensus Reference Sequence
catatatgctttttacattttttttaatcgatattcattttataaaatcataaccgtccattctatgtttygtgtaattcrtgtggatttacytttcataacagatwgcatcattctgtttgtattttgtgcaaataattttcgtactaagtagcaacrttgataaataaaacsaaaaagagattatgatgatgatgatttgtacaaattgtattgcatgaattacaaattaattccgtcactaaactgcatatttgcgccargtatgattttgtcaaaaccyatttaatatttgtaattaatattattattattattattaacgaaaaacatgtgttgtcacrctttatgtttatatytctattttgctaacmcatttttattatattaaatttaaaatt

SEQ ID NO: 1220 - DNA, 401 bp, Artificial Sequence
  Consensus Reference Sequence
actacccacwaagaaattagagaatttgttcctttcaagtgcttgcytcgtgtttttatgagacaattcatcatcataatataatctcaaaataatatctattccttatcagaaaaggataytaccaagatacttacaaaattaacatttaaatgttsaaaattrtctcatataagataatatatattaataatgattgctarcaaataartagcatgaagtacrttaagaagaaaaaaaaaatcccttctttttattcaatttttttttctctcgttctagcgactaaatattttatatcgaaccatcttgaattagacaacattgttttcaaagaaaatgaagtatgggagaatatgttgagtttaattartggaggtamttyacaaawwttttagaag

SEQ ID NO: 1221 - DNA, 401 bp, Artificial Sequence; identical to SEQ ID NO: 665
  Consensus Reference Sequence

SEQ ID NO: 1222 - DNA, 401 bp, Artificial Sequence
  Consensus Reference Sequence
  misc_feature 365: n = A,T,C or G
attggttttgtttcgataagcaaaacaatatagcttttaaatagggttttctaactaaacctaagtaaaaatttcactgaaaaattcaaacttgcttcttatgatwtttaatgaaattcaaataacattctagaaaatatgtagcggtaaacatggcaggagataggtaagtacaggaatatgttgggycgttcacagcaggaacttgagccactgatacaactattgaggaagagcaaagaggttgtttacaagtgttcaaaaatagggaaatacaattttgtggctaagaaattcttaccgwggaaaactaaaattaaagatcttgcagactcaattgagaggtttttcaatattgaaatgcnagctcttattgcacgcgatcaacttgagatcttgct

SEQ ID NO: 1223 - DNA, 401 bp, Artificial Sequence
  Consensus Reference Sequence
attaagtaattaaccaacaagtttcatcctcacgtatgctascctcatcaacttaatcagctcactgctgkagcaagattggaggatccagcttcagcatactcttcatgaagacacgtatgtgcaggttggcttscwaagttaatttggagcgtgataattcatttctggtttggcaacatttcccacctcaactatctgtgtctcttttagtaaatkcagtagggattstaagattatgtgctyagtttrctttgtttttttagttttatgatgtawaaaaaawtatagatcagttagtwgtttggttttaggtwttgttctggtctagatcggatcatgttcygatcttctacatctttagcttttacgcactstgtgcttgaagctaaggggttatc

SEQ ID NO: 1224 - DNA, 401 bp, Artificial Sequence
  Consensus Reference Sequence
aggtygattcactttcaaagttgggccytgycaggygggatcaaacgaycaccttaagggggattgacgataatccgactatttcsgcaraataagggattaactgattgtttatgatatgctggttagtsatgcatcatgaagggacaactaacataaacttawtagcacgaaacatttgcgggatatgatggaatattttgatgcagcataaagaccycgacytgyaaaaattgcggggggaccgaatgtgcttcattttgaggaggctttttccggaacaggtttgttatattttattgyatgttatttagaccggaacaggtttrttatatttttattgcatgttatttagaattaaagtctattatatcacttgtgcatatagcttgcgtcaagtg

SEQ ID NO: 1225 - DNA, 401 bp, Artificial Sequence
  Consensus Reference Sequence
  misc_feature 63: n = A,T,C or G
ttgagattcttagaacatttttggtcaaakaatycattttagkttcttgrattattttttgtnagtcccatgatgttatatagratgcamgaacttytatcattttttattctartastagaatccaattyggattattagattttactagcacaagaaaaaataatatttttgaaaaaataggarttcttttcctagaatcyaatctccatcttaaaaaactcttaataagaataatagtaratctagtggatagrgttcttgagttcaagaatcccattaaagatgytmttgggcctttracaaaytgtccatgttgtgctactcattaacaaaccygtgcttayatttcataggctcyvgtgaaataatagataaaagttatttatatacaaatattt

SEQ ID NO: 1226 - DNA, 401 bp, Artificial Sequence
  Consensus Reference Sequence
attaaagatgytmttgggcctttracaaaytgtccatgttgtgctactcattaacaaaccygtgcttayatttcataggctcyvgtgaaataatagataaaagttatttatatacaaatatttctaaacattattaaatgtattacataaaaactatagrccaataatatcattaaaaatgacgcattttaatatgttaagcaaataagataatttcaaycartctcgaacagaaaatatatakagagagagatatcgagtttaatamttatgtattgatgatgtaaaatgattttacactattataaattattgtttgaattactttaaaataattattttaaaagtcaacaaacttatcacatagtgagttryaattaggtaawggtttaaatatattt

SEQ ID NO: 1227 - DNA, 401 bp, Artificial Sequence
  Consensus Reference Sequence
ctactcattaacaaaccygtgcttayatttcataggctcyvgtgaaataatagataaaagttatttatatacaaatatttctaaacattattaaatgtattacataaaaactatagrccaataatatcattaaaaatgacgcattttaatatgttaarcaaataagataatttcaaycartctcgaacagaaaatatatatagagagagatatcgagtttaatamttatgtattgatgatgtaaaatgattttacactattataaattattgtttgaattactttaaaataattattttaaaagtcaacaaacttatcacatagtgagttryaattaggtaawggtttaaatatatttttggtctctgataaatactcattttttrcatttgktccctaat

SEQ ID NO: 1228 - DNA, 401 bp, Artificial Sequence
  Consensus Reference Sequence
ayatttcataggctcyvgtgaaataatagataaaagttatttatatacaaatatttctaaacattattaaatgtattacataaaaactatagrccaataatatcattaaaaatgacgcattttaatatgttaarcaaataagataatttcaaycartctcgaacagaaaatatatakagagagagatatcgagtttaatacttatgtattgatgatgtaaaatgattttacactattataaattattgtttgaattactttaaaataattattttaaaagtcaacaaacttatcacatagtgagttryaattaggtaawggtttaaatatatttttggtctctgataaatactcattttttrcatttgktccctaataaatttttgctttrtgatgggtcc

SEQ ID NO: 1229 - DNA, 401 bp, Artificial Sequence
  Consensus Reference Sequence
tattttaaaagtcaacaaacttatcacatagtgagttryaattaggtaawggtttaaatatatttttggtctctgataaatactcattttttrcatttgktccctaataaatttttgctttrtgatgggtcccwaatatttaaaaagctttgtccraagttcctrccrttagtcgaaatccattatcttcatatgtgatcgttaaccgattgtcgcaacctacccttcggcgggagggcgacgcgtgactcgcgggatgcgtgttccacgaaaggaatacccgcggagttgccaccaacgtttatttgaggaaaatgtcggaaaaaccggaaaagacgcgatctacgaacttttaagtgaaaggctcgggagttgtattcacgcacggggaaggtattagc

SEQ ID NO: 1230 - DNA, 401 bp, Artificial Sequence
  Consensus Reference Sequence
ttccttctcttcacctacgacacacaagtggrttkgagggccaagtgtgagagagagactgrgagagaagtgaggtttgwgagttgaaggaagttaytggtggtagctggcgctggcacgagcagtggcacgaytggcarcaccagtggtggcygatggctgggttggtggtgacctttaagaagggagaacaagaagaggcaaccatgaaagcaagggtttgcaaaaagagctcgcaactatgaawggtcgaygacaagttcagacatcrctatcccactcattttttcgtgctctatkcaatggaccgagckgaatcgcattttagggtaatttgttgaccttcttctacccatgaaactattttgatgtgttctcttagaaaccttatccatgtgaat

SEQ ID NO: 1231 - DNA, 401 bp, Artificial Sequence
  Consensus Reference Sequence
aatggaccgagckgaatcgcattttagggtaatttgttgaccttcttctacccatgaaactattttgatgtgttctcttagaaaccttatccatgtgaatttcttgagttggkarttggcttggtttgatttgaaaatgyaaaattgattgcaaggtcctaaaaatcrttggtgaggaccwcttcaccttggatcttyacgagtgacgaagtcatagtgayaaatccataagraaggtatagaagaaactatartgggttgtgtgaaaacgtagaggaatgctgaagartgattytttgatgcccaagggattttgactatagtttcttatcattagtcaaaatccgttatttgytgaagaatgattctttkatgyccaargrattttgactatagtttct

SEQ ID NO: 1232 - DNA, 401 bp, Artificial Sequence
  Consensus Reference Sequence
gcaaaaatttattaaagatcaaatgcwatycattccattatgccaacctatgttccttttccacttcagyyagtgcaacttgtackgctgattctttcwgctgtcatacacaagcakgtcttgtttytgaggcccatttgtcctttmtttttctattccycaccccctcttttccctatccttttatataccttyattatgracctatcaagttctaaccaggaaaattccaaaaacatttytaacccaaatctccaaatttacatgatgtsaaatcagaaayaaactaataaataagaaaatgtgattaaaaataatatataacactacagagaaaaaaatcagaaaattmwttttccatgcatactatamagagattacaaagtmwraaaatatatatt

SEQ ID NO: 1233 - DNA, 401 bp, Artificial Sequence
  Consensus Reference Sequence
agtgcaacttgtackgctgattctttcwgctgtcatacacaagcakgtcttgtttytgaggcccatttgtcctttmtttttctattccycaccccctcttttccctatccttttatataccttyattatrracctatcaagttctaaccaggaaaattccaaaaacatttytaacccaaatctccaaatttacatgatgtgaaatcagaaayaaactaataaataagaaaatgtgattaaaaataatatataacactacagagaaaaaaatcagaaaattmwttttccatgcatactatamagagattacaaagtmwraaaatatatattttcatgggaraaatgttcatgtgaacacaataattaccttgactyyrtatagtgatattttgttgcatatc

SEQ ID NO: 1234 - DNA, 401 bp, Artificial Sequence; identical to SEQ ID NO: 678
  Consensus Reference Sequence

SEQ ID NO: 1235 - DNA, 401 bp, Artificial Sequence
  Consensus Reference Sequence
ggggtgyaattaraaaayaagaccaagagagcaattacaagacccacttacytcaaggattaggtgtgaaacaagcaggtgcatcatatctggaagaatgatgctggtcggrtaggaatagacaaacttaacmatttyctgatattytgtagcacaaaaagayaaattsgattaktragaaatcagtataaataatactatgtaataacaacatyaatcaatggaatatacaattrttccttcccttattcttctcattcttctctccrtggaggccctggtccttgaaaamcagcttctatcttcttccctatcaacaagtatatarcatatataattatgtatgataattttaagaaaawaaacaacactaatataaaatatatagaatagtaaaatac

SEQ ID NO: 1236 - DNA, 401 bp, Artificial Sequence
  Consensus Reference Sequence
ttatgtatgataattttaagaaaawaaacaacactaatataaaatatatagaatagtaaaatacaaaaaaaaaacaagatcatatctgcatttccagaagtatcttatggaatctagattacccaggaagwkaaattaaaaacttgaaaraagaaacagagaaaaaagaaaatattttaagataagttgtaacccggaattaaaataaaagtttataaatarttcaagcacatatatatattttggtgtcttgatcttattgatgtattttgcagacattgatatacttttattaccctatagagctrgarcaagatcaactaattgaaggtttagtgacattgtcacaaagcaaagaaaatgcctgatttatgaatattcacyttgaatctacgtgagtc

SEQ ID NO: 1237 - DNA, 401 bp, Artificial Sequence
  Consensus Reference Sequence
attaagaaaacyaaaaattgtatcagatgatatttctctttttcaaaacyaatctaatctactccataaactccttttaatcbgasaactattaggaaagtgaaaaggaaaatataaaaaattaaaaaagtaaataattkgactttgtaraagtcataaccacattctttatcatycttctcttctyygtyccctcattgttgcacykgacacatttctttaacacgttgtcctattgtctgatcaataggaacatgatatatcgcctcgttatttwcwratcatgcaattgcattgatttattttctgttcttatcatgattggttccacattattattatgtcwtgcacttcatcatggtgcgttgcactaatattaatgatcgytctacaaatctttg

SEQ ID NO: 1238 - DNA, 401 bp, Artificial Sequence
  Consensus Reference Sequence
  misc_feature 223, 225: n = A,T,C or G
tttaacacgttgtcctattgtctgatcaataggaacatgatatatcgcctcgttatttwcwratcatgcaattgcattgatttattttctgttcttatcatgattggttccacattattattatgtcwtgcacttcatcatggtgcgttgcactaatattaatgatcgytctacaaatctttgttgtaccccttaaattttattggcttytgccttttttttntnatgraaattaattaattaacattkgtttttkaagtgcttgttaattacaggcaccatkgaggaaagagtgrgacttttgtttytgattttgtcatgcaagagaggtaacaattgttagattggcctttttcttatctttttgcttttaaatttaattatcrtgctaagtgagatgg

SEQ ID NO: 1239 - DNA, 401 bp, Artificial Sequence
  Consensus Reference Sequence
  misc_feature 195, 197: n = A,T,C or G
ataggaacatgatatatcgcctcgttatttwcwratcatgcaattgcattgatttattttctgttcttatcatgattggttccacattattattatgtcwtgcacttcatcatggtgcgttgcactaatattaatgatcgytctacaaatctttgttgtaccccttaaatttyattggcttytgccttttttttntnatggaaattaattaattaacattkgtttttkaagtgcttgttaattacaggcaccatkgaggaaagagtgrgacttttgtttytgattttgtcatgcaagagaggtaacaattgttagattggcctttttcttatctttttgcttttaaatttaattatcrtgctaagtgagatggatayaamrtagttacaactcacaccaaa

SEQ ID NO: 1240 - DNA, 401 bp, Artificial Sequence
  Consensus Reference Sequence
tkaagtgcttgttaattacaggcaccatkgaggaaagagtgrgacttttgtttytgattttgtcatgcaagagaggtaacaattgttagattggcctttttcttatctttttgcttttaaatttaattatcrtgctaagtgagatggatayaamrtagttacaactcacaccaaayttactgtaccataataaagtttacttgrttcttgtagtaataatataaatagtgaygaaccacataccttctaaaaccaaatacycatacctgtttmatatacctartaacttagagatagaatgcaagacttgwattattcactctcctatatatttatttamcaaaytttggtggaaattttaaggagtgacaggttcatawtagcttttaaccatcaatgga

SEQ ID NO: 1241 - DNA, 401 bp, Artificial Sequence
  Consensus Reference Sequence
agtgcttgttaattacaggcaccatkgaggaaagagtgrgacttttgtttytgattttgtcatgcaagagaggtaacaattgttagattggcctttttcttatctttttgcttttaaatttaattatcrtgctaagtgagatggatayaamrtagttacaactcacaccaaayttactgtaccataataaagtttacytggttcttgtagtaataatataaatagtgaygaaccacataccttctaaaaccaaatacycatacctgtttmatatacctartaacttagagatagaatgcaagacttgwattattcactctcctatatatttatttamcaaaytttggtggaaattttaaggagtgacaggttcatawtagcttttaaccatcaatggaaaa

SEQ ID NO: 1242 - DNA, 401 bp, Artificial Sequence
  Consensus Reference Sequence
gaggtaacaattgttagattggcctttttcttatctttttgcttttaaatttaattatcrtgctaagtgagatggatayaamrtagttacaactcacaccaaayttactgtaccataataaagtttacytgrttcttgtagtaataatataaatagtgaygaaccacataccttctaaaaccaaatacycatacctgtttcatatacctartaacttagagatagaatgcaagacttgwattattcactctcctatatatttatttamcaaaytttggtggaaattttaaggagtgacaggttcatawtagcttttaaccatcaatggaaaactggtaaaaagaaaaggctggcactaacaaccagttatttgtchataggaaaggaagcttgggcccaat

SEQ ID NO: 1243 - DNA, 401 bp, Artificial Sequence
  Consensus Reference Sequence
aaaattagtgtstctttgatttcagaagctttacttytttttttccaatacttacaaaaatatcatcttatttttttttacctcatgtcatgrtttgaagaatgtgttttgctacaaagtactgatactttaatttgcttcwtgcatytatatctgataccaatatatctgatacatatatgtgaagtgaccaattcttttaaaaaaattatgataatcaaatatagtgacatrtaacatagawgtaagtataatataraaatataaaaagtattgtttcttgatgaaccaatatgaaaattgttttgtttatagataatttcmagaaagaaatgagattgatcattgatagtaccattcttatttgtgawcaataggaaaaaatgatstacaattttttk

SEQ ID NO: 1244 - DNA, 401 bp, Artificial Sequence
  Consensus Reference Sequence
aakraattggatttagtaaaacgtaaaagkagaaagacatgaaatgaaacatatccttgacagaaatagttttstagttggttagacttagaagatacctgttggtcmtccttggtggctaaatccatctawsrtcaacctsaatgccagggatgtgggaaattttaggccaaatttgagggtgcttcatgcggyatcgtttttccagcaaaggacaahtcaytatggttaattttattagagagacaggaascctttctcccaccatattttccagcaaaggacatcyymwtatggttaattbttgcagggatgtgagatggagaagccccgtgcagtccaacatctccagatttgacawgtbawmtakakacagakacgtaagggwgggaggcagcaaa

SEQ ID NO: 1245 - DNA, 401 bp, Artificial Sequence
  Consensus Reference Sequence
agaagatacctgttggtcmtccttggtggctaaatccatctawsrtcaacctsaatgccagggatgtgggaaattttaggccaaatttgagggtgcttcatgcggyatcgtwtttccagcaaaggacaahtcaytatggttaattttattagagagacaggaascctttctcccaccatattttccagcaaaggacatcytmwtatggttaattbttgcagggatgtgagatggagaagccccgtgcagtccaacatctccagatttgacawgtbawmtakakacagakacgtaagggwgggaggcagcaaaccctcyttagggaaggacttgatgccatcacatsgaccatmaacactgagatgagtaagcatgcccatggatggccatgctaggccgct

SEQ ID NO: 1246 - DNA, 401 bp, Artificial Sequence
  Consensus Reference Sequence
agagacaggaascctttctcccaccatattttccagcaaaggacatcyymwtatggttaattbttgcagggatgtgagatggagaagccccgtgcagtccaacatctccagatttgacawgtbawmtakakacagakacgtaagggwgggaggcagcaaaccctcyttagggaaggacttgatgccatcacatsgaccatcaacactgagatgagtaagcatgcccatggatggccatgctaggccgctcagtagtttctcacaattgtaaatcgatactgttctcaggtcaggtggcataccccgttttggaaaggactcaatttctgggcagttgaatatttygagacattctaactttgggagaagactactcatctcttcakgcaacgacttcaact

SEQ ID NO: 1247 - DNA, 401 bp, Artificial Sequence
  Consensus Reference Sequence
gyctwytatatvcaacgattcaatgttaaagtgaggctgtarcttgcaaagcacatctatttcaagttggaagttgktactgttgttgttacatcyagaccathccaactgtaaactattaatgtgttttttatccatcatccttgcctccaamgcttcatcactttgggaaacattctccawgttcctaakttcaagwtgaccaygaagatttgaaagtcctcccaattctttgatyccattctcttcgtgcttgcccacaacaaagaaatccagacgttgtaaatgatttaatttactcattcctctcggcatctcttttataggagtwwaagaaataycaagatgacgcaagttaacaagattscrcatgtcaytaggcaacttggtcagttttctgc

SEQ ID NO: 1248 - DNA, 401 bp, Artificial Sequence
  Consensus Reference Sequence
ttygacaywatgatacattgtgcctcctcrttgttgaatggagcagcttcaaaattkataatggacaagaaagttctcagaaattttgctctaccaayaacatcaragttgtccaagactgaagaattgaatttggyaaatgacaaatgacgagtyttagtattgatctttgtttctttcccaagttcttctgatctaaagtaaaaatctccaccgastgatktggctagatcatgcatgaggtcatgcatcacaaaacattcgccataaggcctactacttctatytgtacttgaacgttggaaaaayratctygaaaccaaatcatcaaaataytcatgaccmacctcttctaaartcctaccattycttggtttcttcaaaagatcttcrgccatcca

SEQ ID NO: 1249 - DNA, 401 bp, Artificial Sequence
  Consensus Reference Sequence
cctcctcrttgttgaatggagcagcttcaaaattkataatggacaagaaagttctcagaaattttgctctaccaayaacatcaragttgtccaagactgaagaattgaatttggyaaatgacaaatgacgagtyttagtattgatctttgtttctttcccaagttcttctgatctaaartaaaaatctccaccgastgatttggctagatcatgcatgaggtcatgcatcacaaaacattcgccataaggcctactacttctatytgtacttgaacgttggaaaaayratctygaaaccaaatcatcaaaataytcatgaccmacctcttctaaartcctaccattycttggtttcttcaaaagatcttcrgccatccacaacaagattaattcatttttt

SEQ ID NO: 1250 - DNA, 401 bp, Artificial Sequence
  Consensus Reference Sequence
atgttkctttcttgatatttctattttgaatttagctcctctaaactaaagactccagatttaaagagtgatgatatttctaccgttaatttwaaaaaaatggattatatttctaaaatgctctaattaaagttagtgatggccagctttctaaaatgctttaaaatggattatgttttcaracmgtgtggagcagtggtgtgtgtttttttcttggtgacattaaagttgtcatagagatatgttattttataaagatctaatacsgaatyataattttataaacagttgaaataawtgatagygatttgtgtgtttttaatcaartggtaaaagatttaaatctttattaattcttataaatagaataaattttgttgggtggaaaataaaaaaatgag

SEQ ID NO: 1251 - DNA, 401 bp, Artificial Sequence
  Consensus Reference Sequence
aataaataatagatactaataaaatagaatattgtgaagatgttataataataataataatataaagggagtgattaaagtaattcttttgaaatggcggcrtggaaaattattattcaattcaactctttttttatgttatatatctattataattatttgataaatacttccatgaaatttyttggttggtggattattcttcaaatcttatctatataraaatgttattattagtcargtaaaatatatttagtgagatmatctcaaayaacaatagtaaaatgagagataaagaaaatttaagtcaagcaaatgaaaagattttattatatktaaaaaawattttttctcctatcatatttaataaatataatttctataaaatataatttttattt

SEQ ID NO: 1252 - DNA, 401 bp, Artificial Sequence
  Consensus Reference Sequence
gatttttttactccactatacttgctctttcctcatttttttcaaaatagacctgcctcaaaattgtttcctaaacarcactcctttttagyttgcagagagaagtmggggttaggsaacccamcttctctttgctcctattrttttttaatttaaaaaattattaaattctttttttaatattttttaaaaataatttacttgttttttaaatattattttcagataaaaaaataattaaaatttttaatattattattttgttttttaaataatgakaatattttttgtttaattatttattwatartttgaaaataattaattaataatcttaaaataaatttaaaaaacaaagtgattaaaaaaatarattgattaaaaacmcaataaatatatgat

SEQ ID NO: 1253 - DNA, 401 bp, Artificial Sequence
  Consensus Reference Sequence
tttctaaaagtattccattttatttattttatgaataaggagtattaaagtgtatttcactaaaaataaataaaaaatgaaatacagtammttttttaataagatgaagtaaaagaagtgaaattatatatatatatatatatatatatatatataattttcataaatgtagtaataaaataaatgaaaatggcaatttcgttgtggaaagattaaaattcaaattttagtccttraaagtgaaaaagtacgacaaattcattyatctattaactttcatccrttatctttaataaaagagcctacgtgacaccttcagagacaaatttgttagcgctcaacacattcagaggtgaaaatgaatatttayycaaratataatttaatcttcatatttttcc

SEQ ID NO: 1254 - DNA, 401 bp, Artificial Sequence
  Consensus Reference Sequence
cgaaacctggtttgactcaaccrttactcggtggtctaaccgaactagtttcactattggatcggtcatgsaattgacacgggatgatctatccaaactcrgacagttagccaccggatcccggttgcaccggtccgacctaaccggttttacrcacaaaaagggaccatctctacgacatcattttgatatctcgttattatcaattgttatcttggattttgaagtatggatgaattttttttactcaaataatgttagttgtatayttatatataatataaacatatataattttgaatttttataatatattargtcaaaccagtccaatggttaatctatcarttggaccactatccattcatcaaytattttaattggatcaatgaccgaaccag

SEQ ID NO: 1255 - DNA, 401 bp, Artificial Sequence
  Consensus Reference Sequence
  misc_feature 283: n = A,T,C or G
tttatyttttaaagataaacttgtaagcatgagaaaagaaaatagttattaaaaaataaaaatgaaagatctttactcattcaatgattcgagtatgagtatatagagcataacatgagaagtagacatggcaagaaaactcgtacccgtaggtacccgcccgaatycgtctcgactttgacgggtaatayccgagttgatcaggtatgggttcgggaacgrgttttccccgataaccaaaagtcgggtacgggtacgggtatragattattagacccrttcngaccccgaacccgaacccgcccgccacttaaaatttttagaatttttgcataatttaatcaaaaggcrtaaaaattttattactagttaattttattttaraatttttacataattta

SEQ ID NO: 1256 - DNA, 401 bp, Artificial Sequence
  Consensus Reference Sequence
  misc_feature 139, 140: n = A,T,C or G
ttaacaatcaatttattttttctaaaatcaaatttttaatattttttttacaaaaamaatayttttctaagttgaatcgtatatggaacggsgtcggggatacccratacccgacggggatgggacaataaacttaaanncgtcgggtatcgggtacgagtatsgagatatgttagagagtcggggtaaggggttggagagagaatacccgtacctgtcccaccccaccattgccatgtctaacgagaaggcrttaayggactggtactgcraatattcatccgccacrtggcgccatatgattgratgaccttgctactagtmacgggaagagcccgccttgtggttaggtgttgaasgatgtttggcataccatcattttcattgtccctaattcgcac

SEQ ID NO: 1257 - DNA, 401 bp, Artificial Sequence
  Consensus Reference Sequence
ttgagttaaattcaagtgaagcgattgtatgcatgagtgcaaattagcttatttagttkatcagacttttyttataattcacaaaggttgttacaaaaatttaatgtatctaatttaagtatattaatgcattaaaacttatttatatatataagatatatttgttaaatttttaattgraattgtaagaaagatgaagagaagatcaaccagtaggcaaaaatcaaatcaaattcggatcctatcattcatgaggraaatcttgcccaatcataatattgagatttcaccwkattttatttgtgtgaaagattttgatagaatttttcttattcaatactactacaaagtggatastaaaaaacttagaaacaatatagagtatattaatattccttttt

SEQ ID NO: 1258 - DNA, 401 bp, Artificial Sequence
  Consensus Reference Sequence
cttgacaatcaatttgtcctcaaaatgtctaaatgcttctttgcaaaaacgcaggtagagtatctkgggcatctcgtttcmggcagaggagtggaacccatgaccgacaaggtggccgccattgttaattggcctagacctcaatccatccgagctgttcgtagctttctgggcctagcaggtttttatcggcgattcattcgcggatacgctatgattgcagagccgttagttygtctcaccactatggaaactcttcagtggacycctcaykctcaacaagctttcgagaatcttaagtctgccttrgccactgcaccagttctggccttacccgatttccaggttccattcacggtagaaacggacgcttcaggcaacggcatgggagcagtcctatc

SEQ ID NO: 1259 - DNA, 401 bp, Artificial Sequence
  Consensus Reference Sequence
tactagcaacttcgaacctgcttgcttcatttgtgtcatttatcctctgtttccattctttcttcttcattttggtgtcctattcaatttcacttttttcttttgttttcagttgagttttagagctgctgagggcttccatcttcaatacaygtgctctgttgtttagcattttggcgygaggctrtggtttcgggttcgtgatttccgattttctgtagttgaaggttggagttttttccctctrttgtgcatgtgtgtgtttgtcagttttttgttgtttgctgattttcgtctttgcatggttgttttcttctgccacgtgytctgttgtgttttttattataaaaaaaattgttgcttttcttttcgytgccttccatttgtctgttgatcgttgg

SEQ ID NO: 1260 - DNA, 401 bp, Artificial Sequence
  Consensus Reference Sequence
tttggcgygaggctrtggtttcgggttcrtgatttccgattttctgtagttgaaggttggagttttttccctctrttgtgcatgtgtgtgtttgtcagttttttgttgtttgctgattttcgtctttgcatggttgttttcttctgccacgtgytctgttgtgttttttattataaaaaaaattgttgcttttcttttcgttgccttccatttgtctgttgatcgttggattgcatttgcatggttttggattgatcatattattcctttagaggtataattctttggttctatttttttgytgtttgctaacttggctattttgtttttgtcyctttttgttggcttccatttgtgtgytgatggttggattgcatttgcatggttttktattgatcata

SEQ ID NO: 1261 - DNA, 401 bp, Artificial Sequence
  Consensus Reference Sequence
ttcgccggcttccatttgtttgttgatggttgcattgcatttgcatggttttggatttatcacattattcatttagaattgrcagttctatccagctttatggcaaggattcytgacaagattaagtctattgatgggtcaagaaagrcgcttaaasttgatatgagaatcatggatctttggttcgttgggactcccaataagtctgagcaagcggaaatggttattgttgattctgaggyatgttttttgctgtttatttggttgttggattgttgytcataccatcaattggttatatagtttgcatgttacagggtgatcaaattcatgytgtttgtaaagcggaccaactaaagtcttggaaagttgatttgaaggaaaattccacttatgttatg

SEQ ID NO: 1262 - DNA, 401 bp, Artificial Sequence
  Consensus Reference Sequence
ttgaatgaacgtggaaatgatgggycgatcgttattattttgacacatgccagagtaaaagatgcgcagggtaagtgtgatgttatctttactaatttgggtgctgattagataatttttcctgttggttttttcacacttacaggaagttatccagcttcartgagcaattcgttgaaggcctcaaaattattaattaatgaacctgtattggaaatcyaggaatttagggagaggtattttggttatcccctttactatgtgcctgtcaaattggtgtatcaaytgtgttgagtgttttctggtactttttcctatttattcgattgccataggcttttagatttaggtgttgaggtcagcccagttttggcacctrgcgatcawggaagttcacaact

SEQ ID NO: 1263 - DNA, 401 bp, Artificial Sequence
  Consensus Reference Sequence
tcaaattggtgtatcaaytgtgttgagtgttttctggtactttttcctatttattcgattgccataggcttttagatttaggtgttgaggtcagcccagttttggcacctrgcgatcawggaagttcacaactttyagggccaagccaattatcatcaaargatgcatttctttcaaaagctgaagccaaaactattttygagatcaatggcatttctgaggtggtcctgttatttgtgtttattgtgtatgcattacaataaaaagcccaatttgtytagatgtgttcagatcaacatattatgtctaatgtctggygtttatttaatcctggcatttcatggttggcaatttgattgttatggttttctatcaagatgttgtttgtgttacggtgggca

SEQ ID NO: 1264 - DNA, 401 bp, Artificial Sequence
  Consensus Reference Sequence
tgttatggttttctatcaagatgttgtttgtgttacggtgggcactattagcaaaatagtcatggataatcattcatggtgttatccagcttgcgttcaatgycatagaaaaattgacatcgraacaggaccattcacatgcggatgtggcaaagataatgatcagcctattctaaggtaattggagttttggtgcatcagcatctttttattcaggattttgtatttgactggtatgtacattggtaggtatagagttgaagtaatgattagccaaaacaatgacagtagcaagtttttgctctgggaccdtgaatrtgctgagttgattggtcaaacagctkatgaagtgaacagggtcaagattgaagtatgttcgtgtgttatcatataatgcttct

SEQ ID NO: 1265 - DNA, 401 bp, Artificial Sequence
  Consensus Reference Sequence
gctgatactgaggtattgttttctaatgtctattttagttgttattgtcatagtgatatgatgcatgagtttgactatcgtcaacttatatatgatacakgcatgttccaaaatagatgcttcgarcgttgattgcaatgatgctacgcatgttgaatgtgtaagttaagattgttgtcatgagtgttggtytrttacattttttaacggctgaatgaaaaaataaacttggtytgaaatttggatatattttatttaccagtttatgttttatgcarcaatctctgtctgtgacagcagatcatgatccagttgyaggattccctttaacgccaaaaaaacgtctatcatctgatgaagttgatgatgaactaggaagctcccagatttccccagcccaa

SEQ ID NO: 1266 - DNA, 401 bp, Artificial Sequence
  Consensus Reference Sequence
  misc_feature 62, 330: n = A,T,C or G
tcagtcacttagtcacttggttgyatcaaatttaatttcactctaggcaataacatgttggncacaagaatatatattacatattaactttgaaaataaaatataataaaatttctaactcaactttttaawtttcttaattttcattctaatartatggtcactcattataacgacccgcctcgtcgctacgatatcattactctaaaccgcaaagaatttyaatttttaaatgaaaactccattaatttgcttatgaaaaawtaaagtaattttaatttcacgatatacattccsaaacaacrcatcattacttaaatgaatacatanatacatatatatatatatatatatatatatatatatatatgcataataacttagtacacatcattcacata

SEQ ID NO: 1267 - DNA, 401 bp, Artificial Sequence
  Consensus Reference Sequence
  misc_feature 318, 319, 320, 321, 322, 323, 324, 325, 326, 327, 328, 329,330, 331, 332, 333, 334, 335, 336, 337, 338, 339, 340, 341,342, 343, 344, 345, 346, 347, 348, 349, 350, 351, 352, 353,354, 355, 356, 357, 358, 359, 360, 361, 362, 363, 364: n = A,T,C or G
  misc_feature 365, 366, 367, 368, 369, 370, 371, 372, 373, 374, 375, 376,377, 378, 379, 380, 381, 382, 383, 384, 385, 386, 387, 388,389, 390, 391, 392, 393, 394, 395, 396, 397, 398, 399, 400,401: n = A,T,C or G
tatgaagtatgaaacatgggcaccataaagtacaatgaccatggatgaattaaagatcctaagtcatcccctccagagatgcttaaactctttaaccactctattttcccccmccagggacatccgaaaagggcaatgccccccccatgaacatacacaacatacaacrtataaaatgtgggcaccatcaagtacaytgaccatgaatgaattaaaratcctaagtcatcccctcaaagatgcttaaactctttaaccactttattttcccccaccagggacatccgacaaggacaatgcaccccccccccccccccnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1268 - DNA, 401 bp, Artificial Sequence
  Consensus Reference Sequence
gaaaaccaaaaattgtatcagatgatatttctcttcttcataaccaatctaatctactccataaactcctcttaattagacgattattaggaaagtgaaaagaaaaatataaaaaattaaaaaaataaataattcgactttgtaaaagtcataaccacattttttatcatccttctcttctccgttccctcattgttacacctgacacatttctttaacatgttgccttattttttaatcaatatgaacatgatatatcgtctctttattttctgatcatgcaattgcattratttattttctrttcttataagrattggttccacattattattatgtmatgcacttcatcatggtaygttgcactaatattaatgatsgttctacaaatctttgttgta

SEQ ID NO: 1269 - DNA, 401 bp, Artificial Sequence
  Consensus Reference Sequence
gcttaggtatacctataawcactattatwaatrttataggtatagtggtttaataaacactattaatgtgtgacatgggattgaatcaaactataacattttatgaatgttttcatcattttagtctacatcactttgaaaactaaaattctaccattatgcaataaaaaaaactaaaatgacatgattataaaactccctaggactaaaatcaaacaagtcaaattaaaaatcaaataagatgccaaattaatcactatctcagtttaatgccaataccatatcaatcaatgccgccaactatcaaaaggattaaaatctcacacttataatattcaggagactcaattaattagagaatamaattatattataatgatacatgagaaaataagtataat

SEQ ID NO: 1270 - DNA, 401 bp, Artificial Sequence
  Consensus Reference Sequence
  misc_feature 89: n = A,T,C or G
acacttataatattcaggagactcaattaattagagaatamaattatattataatgatacatgagaaaataagtataattaagtcaaanttttacacataaaaamttaataaaaatcatawgtttattataaaaaaaatcattatttcatgtatatgtctcctggtagaaaaagtcttactcaaaattttatctagtgtttattttttttaatgtatcagcgttgaatwtaagaagtatgtacattttttttatttagtatcaccatatgcaattaggatcttaggttcccaataatattctaatgtatrttcataaactttgattatttgaattaattttcaattagaagtgagacttaattatacttaaaatttattatttctttyaaaaaaatgtatt

SEQ ID NO: 1271 - DNA, 401 bp, Artificial Sequence
  Consensus Reference Sequence
atttattatttctttyaaaaaaatgtattttacaaaaatyaaactcaaattctaatccataaacttaacttatattatcaaatgacttatgttattaattctacctgcatattatgctttaaggttgcaaataatacaatcatgcgagaaagaaaaataaataaatttattgacgatcaatagaaattaratartatcaataarataaatatgytaagaaaatagaaatataatttttattgatatgaaacmgtatatcatcttctataacatcatttcatgrttattgatrataaaatattaaaactgaatcacaactaaaaaaataaaatatatatatatatatatatatatatatatatatatatataaatttagatcaattataagttaaatttaaa

SEQ ID NO: 1272 - DNA, 401 bp, Artificial Sequence
  Consensus Reference Sequence
tattatttctttyaaaaaaatgtattttacaaaaatyaaactcaaattctaatccataaacttaacttatattatcaaatgacttatgttattaattctacctgcatattatgctttaaggttgcaaataatacaatcatgcgagaaagaaaaataaataaatttattgacgatcaatagaaattaratartatcaayaagataaatatgytaagaaaatagaaatataatttttattgatatgaaacmgtatatcatcttctataacatcatttcatgrttattgatrataaaatattaaaactgaatcacaactaaaaaaataaaatatatatatatatatatatatatatatatatatatatataaatttagatcaattataagttaaatttaaatca

SEQ ID NO: 1273 - DNA, 401 bp, Artificial Sequence
  Consensus Reference Sequence
taatccatacgtaatgttaggtcatgcgcmaatagtaaactgtattcgaatactatctctgtgtatttttaaatttatcttaagttaaaaaartttatgttaasttaaaataagatacaacmaaaattaacatactagtttgcaaatttattttgataaataaatatatcataagataatgtacaaatatttaaacatmataatatttaaataataaaagatagatttaaatgtattttatattttaaatccaggcacagcaatcacgcgtgcgattggcactaactcagatggagatggctctgtcattgtcttttacctgtcgactcgacgtgattcctttayttttgcgtcaccctcgtcatcacacaacacactcacgtcataataacttctactta

SEQ ID NO: 1274 - DNA, 401 bp, Artificial Sequence
  Consensus Reference Sequence
  misc_feature 5: n = A,T,C or G
ttttnaaattgctatgttatttgtgtttaatttgtakacgcacttaatgtaaaatgyttttccgtaytattatccaaatattaawttttaattgctttgttatttgagtttatygtaaaatatttttatgttttgtacaaaatcattttatcgctagattataataattattaagatgatgatgtgataaatttyytctacaaaattgatgtkataaaataattaaaccctattgaatatttctrtcaaaatattttacaataatgagcattsattaaacttatgatgtatattattacacgtataaaaaaattggcstattattatgtatgtgrtaatyatacaattakaaatttattatcgaaatataaaaaaactaaaaaaatatatttattgattaa

SEQ ID NO: 1275 - DNA, 401 bp, Artificial Sequence
  Consensus Reference Sequence
tatgttatttgtgtttaatttgtakacgcacttaatgtaaaatgyttttccgtaytattatccaaatattaawttttaattgctttgttatttgagtttatygtaaaatatttttatgttttgtacaaaatcattttatcgctagattataataattattaagatgatgatgtgataaatttyytctamaaaattgatgttataaaataattaaaccctattgaatatttctrtcaaaatattttacaataatgagcattsattaaacttatgatgtatattattacacgtataaaaaaattggcstattattatgtatgtgrtaatyatacaattakaaatttattatcgaaatataaaaaaactaaaaaaatatatttattgattaacmtaacatatgt

SEQ ID NO: 1276 - DNA, 401 bp, Artificial Sequence
  Consensus Reference Sequence
ttttattacwcaacttatgtaaaaagcatagattttggaggaaaagtattataactacatgattttactagcatatattgcaatttatattgtaatattcttgttatcygygtttacagtgtaatataaatatagatatagtacggatacagataaaagataaasatgaatattatttatacttcaatgttcggaaggttgaccaatatttaattgggtccacatagaaatcgaaattggacgmatggacgaaaaaggrcaaacctcttgacgggwgaatacgtgctcctacgttgtggctaacaaaggatactatagtaaattcatcaaaataactgtatctaagtggcgcattttccggtrctagcggtcgcaytttccattatacgctatatttcwgc

SEQ ID NO: 1277 - DNA, 401 bp, Artificial Sequence
  Consensus Reference Sequence
atgattttactagcatatattgcaatttatattgtaatattcttgttatcygygtttacagtgtaatataaatatagatatagtacggatacagataaaagataaasatgaatattatttatacttcaatgttcggaaggttraccaatatttaattgggtccacatagaaatcgaaattggacgmatggacgaaaaagggcaaacctcttgacgggwgaatacgtgctcctacgttgtggctaacaaaggatactatagtaaattcatcaaaataactgtatctaagtggcgcattttccggtrctagcggtcgcaytttccattatacgctatatttcwgcgtatttatctgttcttttggatattttaatttgggtactttttttgatgaatttttta

SEQ ID NO: 1278 - DNA, 401 bp, Artificial Sequence
  Consensus Reference Sequence
ctgcctccwcaaatttactaactaagtcattcaatcccttaaccattataagggacaaaaagacaccaaagaatcaccttgttyagaccrctttcatccagaaactccattattagactaccattgaccaaartagacatacaacttaagcaagttgctttaatccactttctccaarcactatcaaatycaagacagtytaacatgtaatcaaataatttatcattaacaragtcacrccatcaattaatgctacracttaaaaaagaaaactaaawtttttaacaaagaatmatataargacaaaaaaatgctaawwtttttgtctaaggactaaaacataatttaactatctaaaaaattattctcatttaagaatgtawgaaaattttattcttatt

SEQ ID NO: 1279 - DNA, 401 bp, Artificial Sequence
  Consensus Reference Sequence
acaaaaatttaatctggctggatttytattgtcaaaatcatgttgaatttgaacggtgcstaatatcattattcattctgtttgggaaacatggaatgagtttgggatggtatcatatgataattccwtaataaattattgaaattaatatatatgcttmcactaatttgtcttctgacaaagttttcaagcatgcactggatgaaaagatgattaaaagttgctcttacaattttcgttttcaaactcaagttctgtataagatgtaaacaatttagaatatgtattgacttggatcaataagtctgcaaaccttctttatttgawtgaaaatgggcattaccaagrgattcatgctcagattcttaatcctgattttttctctgttgtagttctgctta

SEQ ID NO: 1280 - DNA, 401 bp, Artificial Sequence
  Consensus Reference Sequence
cwtaataaattattgaaattaatatatatgcttmcactaatttgtcttctgacaaagttttcaagcatgcactgratgaaaagatgattaaaagttgctcttacaattttcgttttcaaactcaagttctgtataagatgtaaacaatttagaatatgtattgacttggatcaataagtctgcaaaccttctttatttgattgaaaatgggcattaccaagrgattcatgctcagattcttaatcctgattttttctctgttgtagttctgcttatgagcaatcaacgtattgtgatrtgtttcactcaaatgattctggttggagagaatgcacatcatgtgacaaggtagagttaaaaaatatatacgtattttggtacactggtagagtatatagaag

SEQ ID NO: 1281 - DNA, 401 bp, Artificial Sequence
  Consensus Reference Sequence
ccgagaagaaaagaactcggaatattgggtcaaaaagtaagaggttgcttatcgatagccaggatgcgctggagctgaaacttacttgggaagaggctcaagatttgctccgtcctcctccaactgttaagccaagcattgtcwtgattgaggatcatgtatttgaagaatatgaagtaagtaaacaatttagaaggagctgtaattttatgaaattcacccattctattagtggtaggttaaattgatatttttggtgtctgtttaactcagacaccaactttgacccaaataaatatgtatgaaccttttcattctaataagttcttaatgcattcatcttaccctaaacttcttctatctaaatctaaagacaaaaatctgacttctaatttctaaaa

SEQ ID NO: 1282 - DNA, 401 bp, Artificial Sequence
  Consensus Reference Sequence
aaattctttcaactacttatagtaaatatatattttttaatataayaaaaaawttgytattcatcaaatgttttcttgtttttgttttctttcctaagggagctctttagcattctcctttataaaaataaaaaaatgaattttgctttcatcrgttatgtcaaggcacaagacactaaccaatattagggctagtgtctcagcttcacaaatgtcttaatacataaatatttaaagttaagtctccactaagtctaggtaaataacattaaatttattatattacctgtttaaggttatgcacaggaattgacttatttcaattcatacaggaacctcctgtctttggaaagaggagtatattcgtagttcgatcaactgggtaagatgagtattgtaca

SEQ ID NO: 1283 - DNA, 401 bp, Artificial Sequence
  Consensus Reference Sequence
agcgtgctgmtggaggcgttggagattgatcggacggatacaaatcagtatccgtgtgtttttggccgktwcaaatcggacrgcacctgatcttcgarytgtgttttctaaatttgaataaacggctgagatgcaatttgggactggagacacggatggtrraatccaattcattttcctctccaaacaaaacccaaatmgsaacggtgcgttttatttgcatttttatttcttttttttattttttgaaaattgtttttatttttaaaaaattagaattttgaaaamatgtttagtttgatttcttgttttttrctttcaagagataaaaacactgaaaatatgttttcaaatggaaatgtatttttaaatttccttaaaattacattctttccyatcat

SEQ ID NO: 1284 - DNA, 401 bp, Artificial Sequence
  Consensus Reference Sequence
gcgtgctgmtggaggcgttggagattgatcggacggatacaaatcagtatccgtgtgtttttggccgktwcaaatcggacrgcacctgatcttcgarytgtgttttctaaatttgaataaacggctgagatgcaatttgggactggagacacggatggtrraatccaattcattttcctctccaaacaaaacccaaatmrgaacggtgcgttttatttgcatttttatttcttttttttattttttgaaaattgtttttatttttaaaaaattagaattttgaaaamatgtttagtttgatttcttgttttttrctttcaagagataaaaacactgaaaatatgttttcaaatggaaatgtatttttaaatttccttaaaattacattctttccyatcatg

SEQ ID NO: 1285 - DNA, 401 bp, Artificial Sequence
  Consensus Reference Sequence
tttcttgttttttrctttcaagagataaaaacactgaaaatatgttttcaaatggaaatgtatttttaaatttccttaaaattacattctttccyatcatgttttcattttatayaaaatgaggtttcaagtttcaactgaaaataatgaaaactaaattttattatttccagattttgatttgttttaaaaaatatttttatcaaaaatgaaaacagaaattcaaccaaacacatttytatcatcattttttatttttaataaaaatgaaaataaaaaataactaaatcaaacacccytdataatsttcatgcttcgaccaagattacttaaaaaatggtttaatatgaaactcacaatctcttttastgtctyatatgacaaatttgcaagcttaagtt

SEQ ID NO: 1286 - DNA, 401 bp, Artificial Sequence
  Consensus Reference Sequence
acatttytatcatcattttttatttttaataaaaatgaaaataaaaaataactaaatcaaacacccytdataatsttcatgcttcgaccaagattacttaaaaaatggtttaatatgaaactcacaatctcttttastgtctyatatgacaaatttgcaagcttaagttaagatatacactcaaagatttttacaattccgataaayratttttaaactttatcaattctctatctcttstgttgacatctcatatatataaaggaggcttcaaawayatctattatgagttatgtttgagtttcttttsttwatttttttctgtgggcaaaaatgattattcgaamattaaatattttttaccaactagtcatmttaataagataagtaatttgcataat

SEQ ID NO: 1287 - DNA, 401 bp, Artificial Sequence
  Consensus Reference Sequence
ttcatgcttcgaccaagattacttaaaaaatggtttaatatgaaactcacaatctcttttastgtctyatatgacaaatttgcaagcttaagttaagatatacactcaaagatttttacaattccsataaayratttttaaactttatcaattctctatctcttstgttgacatctcatatatataaaggaggcttcaaatayatctattatgagttatgtttgagtttcttttsttwatttttttctgtgggcaaaaatgattattcgaamattaaatattttttaccaactagtcatmttaataagataagtaatttgcataatgagtctaacttcaaactaacgagtctcactcctattttttttatagtttgtaayaaattttactagtaactaata

SEQ ID NO: 1288 - DNA, 401 bp, Artificial Sequence
  Consensus Reference Sequence
tatagtttgtaayaaattttactagtaactaataataaaaaaaaagtgttaaaagaaaagtatttaacwgtattttgatatcacttttatatcratatatactagtattttaacccatrcaatgcatataataattttttattttatatgactaaaatttataaagaataaatatatttgaatatataaattatattgtcgttattgaaaataatccaaatcccgcgttgactaacagtaatcttacattaaaatatataaatgagggacaacyctcrttccttgataaataatttatattgtagtaaatttatttttaattattacttatttcaattaaaaacaaatttatattagaaataaagataaaaaagataacttaaaagagataagatgctcat

SEQ ID NO: 1289 - DNA, 401 bp, Artificial Sequence
  Consensus Reference Sequence
  misc_feature 365: n = A,T,C or G
gaaaataatccaaatcccgcgttgactaacagtaatcttacattaaaatatataaatgagggacaacyctcrttccttgataaataatttatattgtagtaaatttatttttaattattacttatttcaattaaaaacaaatttatattagaaataaagataaaaaagataacttaaaagagataagatgctcatttttttaaaaaaataaaaaatcaaatttaaccaaaaaaacaaagtctttatgcatgaatatataaattatattgtcattaaaaattataataataaatatatttygacatattaattatgatttatatcttatgataaataatttatattrtggtaaatttatttttaantattacttatttcaattaaaaaccagtttatattga

SEQ ID NO: 1290 - DNA, 401 bp, Artificial Sequence
  Consensus Reference Sequence
cattaacaccaaaaggtatttggctctttttgttatcttttggctgttataakttgtttgatttgtatttttattttttgttttcatttttcgaaaaaaaatttcatttttaaaagattagaaattttaagaatatgtttgatttgatttcttgttttctgcttacaagaaataaaaakactgaaaatgcgtttttaaaagaaaatgtatttttagatttgcttaaaattacattctttgtcaccgtgttttcattttactcaatatgagattcctgattttarctgaaaayactgaaaataaaattttattgtttytaattttttgttcgtttgaaaaaatattttaaaaaatttaaccaaacgcatttccatcattattttctatttccaataaaaata

SEQ ID NO: 1291 - DNA, 401 bp, Artificial Sequence
  Consensus Reference Sequence
tcatttttcgaaaaaaaatttcatttttaaaagattagaaattttaagaatatgtttgatttgatttcttgttttctgcttacaagaaataaaaakactgaaaatgcgtttttaaaaraaaatgtatttttagatttgcttaaaattacattctttgtcaccgtgttttcattttactcaatatgagattcctgattttagctgaaaayactgaaaataaaattttattgtttytaattttttgttcgtttgaaaaaatattttaaaaaatttaaccaaacgcatttccatcattattttctatttccaataaaaataaaaacaaaaaaaaaatcaaattaaataccccttaatttttbatagtgcaacaccaagggcagtgttgcttygagcaacagagt

SEQ ID NO: 1292 - DNA, 401 bp, Artificial Sequence
  Consensus Reference Sequence
cgaaaaaaaatttcatttttaaaagattagaaattttaagaatatgtttgatttgatttcttgttttctgcttacaagaaataaaaakactgaaaatgcgtttttaaaaraaaatgtatttttagatttgcttaaaattacattctttgtcaccgtgttttcattttactcaatatgagattcctgattttarctgaaaatactgaaaataaaattttattgtttytaattttttgttcgtttgaaaaaatattttaaaaaatttaaccaaacgcatttccatcattattttctatttccaataaaaataaaaacaaaaaaaaaatcaaattaaataccccttaatttttbatagtgcaacaccaagggcagtgttgcttygagcaacagagtcgtgcatc

SEQ ID NO: 1293 - DNA, 401 bp, Artificial Sequence
  Consensus Reference Sequence
ttattaaaaatcataaaattcatgtgtgtgaagtcattttaagtttttacttgaaatgaaggatacagtataaataagctaaatataatttcttctaaacacgccttgaatctgaagtctattgataaaattgattcacacaagtcgatcgrttcatcactactgctttctagttttcacatcggttctgagtgatartttggatggttggttaacagatgtatggtgcgattcaagtttcaaaaacttcattaattagttasttctggacaaaatgctgataaatgctatcgtctgatattgaataccagcaacatacttgataaattgtwaattaattttttatataatgcttgatcackcattacatagtcacacacacatataatggccagtgtata

SEQ ID NO: 1294 - DNA, 401 bp, Artificial Sequence
  Consensus Reference Sequence
attgtaattctatgaaatctatcttggtgagtggtgttttgatatcactatagggacatgttgattgttgtggtgtaggcatgaatggtgatctagtactaagtgtgaacgtgcgataatgwgcattatggtcttagccctatagattttgggatagccataagtgatggtgtgatgatggtttaataatgacatcaagagwatcataaaacccttcaaatagaccaagccacaaaaatgagctttttggtcaggtcttyaaaatagattatcggattttaaaaattagactataatagaaaaatacgtcatacttaaattcataattatsaaycatgctaggtttaggttcatcaaatcctagttcaacttgatttttttcactcataagttatgttatt

SEQ ID NO: 1295 - DNA, 401 bp, Artificial Sequence
  Consensus Reference Sequence
ttttttttctataacaaagactaataatgaccaataaatcaatattttagggatatttttataagagaaaatttaaagatcaaataaaaaaatttagataaattataaggaccaaaaatatatttaagtcaataatataatatcataaaataaaataaaataaacaataacttataatctttaatattatatattttaggttattttttcagtaaacaaaatattgtatattttaattataatttaatcactttgtttaaaatgattttcttctataaagttgtgttgtttaaatgttttctttttcctctaaatactttgcaactaaaataagatatgattatcattataryaattttgttgtatttcacattttcacactaaaaaatttggtaaataaa

SEQ ID NO: 1296 - DNA, 401 bp, Artificial Sequence
  Consensus Reference Sequence
tcgttttctcktattcatgtcataatgtagggaaacttaaccatattgtaattcataaaagaaatatttaaagcaattatttaaaataatccacaaatgaaaaacactggtaatgctaacagctctccactactatttatattttttaaataaaagcatttataaattataaatctaaggtacaaatagaaaataaaaaatatattactttttcataaaaatggtattactttaatagtaaaatatttttaaactcctcgactaatatccaatcatacactaagacaatrcggtacaaaagtacttctcaatccayatgtatttatccttaaatatacgaataaatkattaaaagatatataactccasaattcatgacagttttgcataaattagatatt

SEQ ID NO: 1297 - DNA, 401 bp, Artificial Sequence
  Consensus Reference Sequence
ctaacagctctccactactatttatattttttaaataaaagcatttataaattataaatctaaggtacaaatagaaaataaaaaayatattactttttcataaaaatggtattactttaatagtaaaatatttttaaactcctcgactaatatccaatcatacactaagacaatrcggtacaaaagtacttctcaatccatatgtatttatccttaaatatacgaataaatkattaaaagatatataactccasaattcatgacagttttgcataaattagatattttttactgagcacaaattagattttaaaaatgttttcgagaattcgcaaggtgacaaaagacatcaacaatattttttaacattttcatcctataatttccaaatcgttttcaga

SEQ ID NO: 1298 - DNA, 401 bp, Artificial Sequence
  Consensus Reference Sequence
ataaatctaaggtacaaatagaaaataaaaaayatattactttttcataaaaatggtattactttaatagtaaaatatttttaaactcctcgactaatatccaatcatacactaagacaatrcggtacaaaagtacttctcaatccayatgtatttatccttaaatatacgaataaatkattaaaagatatataactccagaattcatgacagttttgcataaattagatattttttactgagcacaaattagattttaaaaatgttttcgagaattcgcaaggtgacaaaagacatcaacaatattttttaacattttcatcctataatttccaaatcgttttcagagcttcaccttcagccaacatccacacacatcaacagaaaataaattttttcta

SEQ ID NO: 1299 - DNA, 401 bp, Artificial Sequence; identical to SEQ ID NO: 743
  Consensus Reference Sequence

SEQ ID NO: 1300 - DNA, 401 bp, Artificial Sequence
  Consensus Reference Sequence
gtcatttgattgcaaatataagtatttataatattaaaaatagattagaaagagaaaatatatttaaaaagaaataagtaacactcaaatattttttttwaaaaaaatagcaaattaactatttttacaatgaagattataaagaatacttccttccgtcttgactgtaagaaaaaaaawtttcatatttattaaaaaaattgataaattttattaaattgtgtcattttaaattaaatatataayagacatttttcctaaatcattatttattaaaacttgatattaagtataaaaaaatatttttttattaaatgaaaaatattttagmragagatacaagaatagagatttgtttatatttgacacaaataagagacttttattacttatattcatga

SEQ ID NO: 1301 - DNA, 401 bp, Artificial Sequence
  Consensus Reference Sequence
  misc_feature 128: n = A,T,C or G
attttsgagataatattcttggagggagaaaaargaatctcatgaagacagtacaagtgraggtttcaatctcttctccgtctctctgacatttgrgaattctatcggagcagtcggagkaataactnaagraatctcagggaaccgctatagatgttactatcgttggctgaagacacgtgagtccgctcagaggtaagggatgagtttatcgcaattggggattakaatgaacatgtgtagggatccttagagaactaaagttgggtttattttgggatgtttattgaattataattttctctttatgattataaatataatattattgtgttctatgtaccaattgatgtcctgatgagaattgattgataaacttgagtgctcttgatgtctttgtg

SEQ ID NO: 1302 - DNA, 401 bp, Artificial Sequence
  Consensus Reference Sequence
tgtattattatgttttgatyggagtgtgtgattcytgtgtataatgattgatgattgaaatgtgtgattgatggatgaaaagtgtgattgatgaatgacaaartgatgaaataatgtgagatatgctaagtaaattgtatttgactactatatgttgtgttgtttctctctagtagttagmaatgtgataactcactcccggtttgctgtttgtgtttggatcctgtgatgatcttgaactttgtgttcgggggagcagatgaataggtggatgactatgaagaacctcatgctagaggacacrggaacaccaygctctgataggatgtgacattaggatataggttctatattaattgtatgagacttakatgactttctttgagtcgagatgactttat

SEQ ID NO: 1303 - DNA, 233 bp, Artificial Sequence
  Amplicon
gaaaatatgtaaaagaagaactgccagattatataaataagtttatccttgtcagttcatatatatatacacaatggaagattgtttagcaatatttctttgcatttcttttatgtgataaaaagtatgtgtaataatatgggggttgctgatgtgtatgtgaggttgtgaaactttgtttttaaataaaaataattcaaatctcctgttttgtctctccacgaggcattttt

SEQ ID NO: 1304 - DNA, 233 bp, Artificial Sequence
  Amplicon
gaaaatatgtaaaagaagaactgccagattatataaataagtttatccttgtcagttcatatatatatacacaatggaagattgtttagcaatatttctttgcatttcttttatgtgataaaaagtatgtgtaataatatgggggttgctaatgtgtatgtgaggttgtgaaactttgtttttaaataaaaataattcaaatctcctgttttgtctctccacgaggcattttt

SEQ ID NO: 1305 - DNA, 148 bp, Artificial Sequence
  Amplicon
ctccagcgggagatttgcttcttcaagaagactcgtcatgctcaagctgttcggcccagcttgcacatcttctctatcaggttggcaattcaagtctaattgtcccttggcagcttcagccaccgcatcgtctggactccttgaatct

SEQ ID NO: 1306 - DNA, 148 bp, Artificial Sequence
  Amplicon
ctccagcgggagatttgcttcttcaagaagactcgtcatgctcaagctgttcggcccagcttgcacatcttctcgatcaggttggcaattcaagtctaattgtcccttggcagcttcagccaccgcatcgtctggactccttgaatct

SEQ ID NO: 1307 - DNA, 122 bp, Artificial Sequence
  Amplicon
cttgcattctggaggtgctagtcccgaatccagcaatttccctgcgtttgcacgtaacatagtttctagtattagttaaagggcaaaactaaaaaatatgtgcaccaaagaataggggatgg

SEQ ID NO: 1308 - DNA, 122 bp, Artificial Sequence
  Amplicon
cttgcattctggaggtgctagtcccgaatccagcaatttccctgtgtttgcacgtaacatagtttctagtattagttaaagggcaaaactaaaaaatatgtgcaccaaagaataggggatgg

SEQ ID NO: 1309 - DNA, 92 bp, Artificial Sequence
  Amplicon
atgaggacacaatgccatgaaccccagatcatatatcgcatctccttatagtatatgtttcattttgtgtctgcataggattggccttctca

SEQ ID NO: 1310 - DNA, 92 bp, Artificial Sequence
  Amplicon
atgaggacacaatgccatgaaccccagatcacatatcgcatctccttatagtatatgtttcattttgtgtctgcataggattggccttctca

SEQ ID NO: 1311 - DNA, 221 bp, Artificial Sequence
  Amplicon
attttgggcaaatgatgaagctagactgataattgattaattttgggcaaataatattatattacatgtatgagattgattttaagtgtatatgcatacatgaagcaatagacttaatttaattaccttaaggagtgctggacttttgaggatgcccttttgtgctgatgagccctccatggttgacatacaaagcaaattgcagggtgtctttagctgag

SEQ ID NO: 1312 - DNA, 221 bp, Artificial Sequence
  Amplicon
attttgggcaaatgatgaagctagactgataattgattaattttgggcaaataatattatattacatgtatgagattgattttaagtgtatatgcatacatgaagcaatagacttaatttaattatcttaaggagtgctggacttttgaggatgcccttttgtgctgatgagccctccatggttgacatacaaagcaaattgcagggtgtctttagctgag

SEQ ID NO: 1313 - DNA, 183 bp, Artificial Sequence
  Amplicon
tgacacgtggtgcgttaggaattttgtttttaataattttccacaytaaaaagtgattttcatgtggctcaatttttttttaaaaaaaaaattgaattaacactmatgtgacatttttatgtggaacatgtcaacctatataagtaataatttagaagttaccacctgaactaatgcgtttca

SEQ ID NO: 1314 - DNA, 183 bp, Artificial Sequence
  Amplicon
tgacacgtggtgcgttaggaattttgtttttaataattttccacaytaaaaagtgattttcatgtggcttaatttttttttaaaaaaaaaattgaattaacactmatgtgacatttttatgtggaacatgtcaacctatataagtaataatttagaagttaccacctgaactaatgcgtttca

SEQ ID NO: 1315 - DNA, 153 bp, Artificial Sequence
  Amplicon
gaaaacgaaaattgtaagagcaacttttaatcatcttttcatccagtgcatgcttgaaaactttgtcagaagacaaattagtgkaagcatatatattaatttcaataatttattatggaattatcatatgataccatcccaaactcattccat

SEQ ID NO: 1316 - DNA, 153 bp, Artificial Sequence
  Amplicon
gaaaacgaaaattgtaagagcaacttttaatcatcttttcattcagtgcatgcttgaaaactttgtcagaagacaaattagtgkaagcatatatattaatttcaataatttattatggaattatcatatgataccatcccaaactcattccat

SEQ ID NO: 1317 - DNA, 212 bp, Artificial Sequence
  Amplicon
ccaaagctgtcttggaggaacttgaaaaggtatcttacttcttttatttaagtaagttctggcattcttgaattaaatatgtaagaaaagtgaagagaagcttagtattagttgttgttcacaaaatatcaaattatttcatttccttttaaaattatactagcttgttgtttgcacatgtaaaagagttcatgttaaaagcatctgttttg

SEQ ID NO: 1318 - DNA, 212 bp, Artificial Sequence
  Amplicon
ccaaagctgtcttggaggaacttgaaaaggtatcttacttcttttatttaagtaagttctggcattcttgaattaaatatgtaagaaaagtgaagagaagcttagtattagttgttgttcacaaaatatcaaattatttcatttccttttaaaattatactagcttgttggttgcacatgtaaaagagttcatgttaaaagcatctgttttg

SEQ ID NO: 1319 - DNA, 150 bp, Artificial Sequence
  Amplicon
ttctcaccttctgttgtattggagtaagtatgaggtgcagttccaaatctcatagaagtgagaaaaaaaacatataaaatgagtaaaagattcataaacctaatctttgaagttttgaattaaaatgtagtgttaaatttccttgtgtga

SEQ ID NO: 1320 - DNA, 150 bp, Artificial Sequence
  Amplicon
ttctcaccttctgttgtattggagtaagtatgaggtgcaattccaaatctcatagaagtgagaaaaaaaacatataaaatgagtaaaagattcataaacctaatctttgaagttttgaattaaaatgtagtgttaaatttccttgtgtga

SEQ ID NO: 1321 - DNA, 107 bp, Artificial Sequence
  Amplicon
tgaactttgtgaaggacattttgatttgtatctttgaactttataatatgattagtacagcagtatggaatttgtgaagatattttctgagggcagactgttcaagg

SEQ ID NO: 1322 - DNA, 107 bp, Artificial Sequence
  Amplicon
tgaactttgtgaaggacattttgatttgtatctttgaactttataatatgactagtacagcagtatggaatttgtgaagatattttctgagggcagactgttcaagg

SEQ ID NO: 1323 - DNA, 123 bp, Artificial Sequence
  Amplicon
tgtgcaattctcccatcaaaattggagttttaacttggcaatttgcaagatagaaatttgcattaaaggattatgcaaattaccttggtgaaactccaattttgattggagaacgtgtaaaca

SEQ ID NO: 1324 - DNA, 123 bp, Artificial Sequence
  Amplicon
tgtgcaattctcccatcaaaattggagttttaacttggcaatttgcaagataaaaatttgcattaaaggattatgcaaattaccttggtgaaactccaattttgattggagaacgtgtaaaca

SEQ ID NO: 1325 - DNA, 148 bp, Artificial Sequence
  Amplicon
attcctgcagcttctccatcttatctttgaacctttcctgatgcttagtcattgcttctccataactacctttctggtgtctgacataagaaggatcgactttgtaaaagaccggtataaccaacagcccttccctcttgcagtgaaa

SEQ ID NO: 1326 - DNA, 148 bp, Artificial Sequence
  Amplicon
attcctgcagcttctccatcttatctttgaacctttcctgatgcttagtcattgcttctccataactacctttctggtgtctgacataagaaggatctactttgtaaaagaccggtataaccaacagcccttccctcttgcagtgaaa

SEQ ID NO: 1327 - DNA, 140 bp, Artificial Sequence
  Amplicon
tcatgcttgtcaacatcatctaaaatcaagagaaccttctttcgctgaagccgatgttgtataattgaagctccttgttcaacacttgctaagttgatttccttctctccaagtatttcccgaagaaggatgctctggag

SEQ ID NO: 1328 - DNA, 140 bp, Artificial Sequence
  Amplicon
tcatgcttgtcaacatcatctaaaatcaagagaaccttctttcgctgaagcctatgttgtataattgaagctccttgttcaacacttgctaagttgatttccttctctccaagtatttcccgaagaaggatgctctggag

SEQ ID NO: 1329 - DNA, 144 bp, Artificial Sequence
  Amplicon
gaccgtagagaaagtggcagagtgaacagcataattccagtgaactatgttgctcttccaaaagatgactctgtttctagggggaattaagggctgccctctaatttgactcctgaatcagtcagctttgaaaatgcgcttatt

SEQ ID NO: 1330 - DNA, 144 bp, Artificial Sequence
  Amplicon
gaccgtagagaaagtggcagagtgaacagcataattccagtgaactatgttgctcttccaaaagatgactctgtttctagggggaattaagggctgccctctaatttgactcgtgaatcagtcagctttgaaaatgcgcttatt

SEQ ID NO: 1331 - DNA, 128 bp, Artificial Sequence
  Amplicon
aaagaagtttaatttgcaaatagcttgaatttttcaaataccatactcaaaaattaccgatttttctgggtccggtaacgttccacgttgggcttaaactaactttgccatggaaactcattggagta

SEQ ID NO: 1332 - DNA, 128 bp, Artificial Sequence
  Amplicon
aaagaagtttaatttgcaaatagcttgaatttttcaaataccataccaaaaaattaccgatttttctgggtccggtaatgttccacgttgggcttaaactaactttgccatggaaactcattggagta

SEQ ID NO: 1333 - DNA, 166 bp, Artificial Sequence
  Amplicon
caggaaagttgaattgctttatccaaataaaatttaaaaaacgaaagaagtttaatttgcaaatagcttgaatttttcaaataccatactcaaaaattaccttgatttttctgggtccggtaatgttccacgttgggcttaaactaactttgccatggaaactctg

SEQ ID NO: 1334 - DNA, 166 bp, Artificial Sequence
  Amplicon
caggaaagttgaattgctttatccaaataaaatttaaaaaacgaaagaagtttaatttgcaaatagcttgaatttttcaaataccatactcaaaaattaccttgatttttctgggtccggtaacgttccacgttgggcttaaactaactttgccatggaaactctg

SEQ ID NO: 1335 - DNA, 200 bp, Artificial Sequence
  Amplicon
cacattataggggccttttgttatttcttcagcaatttaataaatgttgatgtgttaatttgcaaacccatgataactggttttaattgtgggctgtctccatactctacacaagctaaacaatgtttccttattattttttactcctgttttattttctgacttgtttgggaaatgcacaggtgggagaaaatatgcaa

SEQ ID NO: 1336 - DNA, 200 bp, Artificial Sequence
  Amplicon
cacattataggggccttttgttatttcttcagcaatttaataaatgttgacgtgttaatttgcaaacccatgataactggttttaattgtgggctgtctccatactctacacaagctaaacaatgtttccttattattttttactcctgttttattttctgacttgtttgggaaatgcacaggtgggagaaaatatgcaa

SEQ ID NO: 1337 - DNA, 137 bp, Artificial Sequence
  Amplicon
cgtccgagattggaaattgtagctctctttacttgctgtatgcatcctatttctcaagctctagtgtcatttctyttaacacatctttttggaagatatactaattcctatctattttatgcggagtttgtctcaca

SEQ ID NO: 1338 - DNA, 137 bp, Artificial Sequence
  Amplicon
cgtccgagattggaaattgtagctctctttacttgctgtatgcatcctatttctcaagctctagtgtcatttctyttaacacatctttttggattatatactaattcctatctattttatgcggagtttgtctcaca

SEQ ID NO: 1339 - DNA, 20 bp, Artificial Sequence
  Primer
gggaagaatcccagttggag

SEQ ID NO: 1340 - DNA, 20 bp, Artificial Sequence
  Primer
caaacaaacttgcgttgcag

SEQ ID NO: 1341 - DNA, 16 bp, Artificial Sequence
  Probe
tcatctgtcccgatcc

SEQ ID NO: 1342 - DNA, 16 bp, Artificial Sequence
  Probe
tcatcagtcccgatcc

SEQ ID NO: 1343 - DNA, 401 bp, Artificial Sequence
  Consensus Reference Sequence
crccggagtgtccaykggtgttgagtcctaatatttctttgtgsctctaggtcatgatttaaatacttaaagacccttgaaaatttacaaacaaacttgcgttgcagatatatttcaaaaccctagcatacrtctagcatgggaggggtgcaaccagtcactacaaaaatcatttgaaaaaattaattgcggatcgggacwgatgacaactgtgcgtaccttaaagggaaycagcraatgagagggtacatataaaattgaaggtgtgaaactcctagcctccaactgggattcttcccrcaagtgtcgtttgaagttaagccgcaaaagaagctatgactggctatggytggctatggggggttgtgcacgttgtcctgggttagggtatatattgtata

SEQ ID NO: 1344 - DNA, 212 bp, Artificial Sequence
  Amplicon
caaacaaacttgcgttgcagatatatttcaaaaccctagcatacrtctagcatgggaggggtgcaaccagtcactacaaaaatcatttgaaaaaattaattgcggatcgggacwgatgacaactgtgcgtaccttaaagggaaycagcraatgagagggtacatataaaattgaaggtgtgaaactcctagcctccaactgggattcttccc

SEQ ID NO: 1345 - DNA, 401 bp, Artificial Sequence
  Consensus Reference Sequence
tatatatatatatatatatatatcacgcacaamatggttccattgrcatgaaagttacattagtgcaattatamcatgaagaaaaatgtattcttcgattttttgtttrccaaacaaataggaggaataatattttattttactttcatatttttaatagtatttatcaaaaktttatccaaacacatgtggtcttttttawaaaaaaaaataatctgaaaacaaggaagcatgcaaactaagaaatgagaaratatattctcaaataaatttaccaagaaagtttttctatcgatttttartctccaaaattatttccaaatcaatacttattaaatcggtgttttcatcttactgtatcatggaaatcagttyttcaaattattttacaaaatagattt

SEQ ID NO: 1346 - DNA, 401 bp, Artificial Sequence
  Consensus Reference Sequence
tatatatatatatatatatatatcacgcacaamatggttccattgrcatgaaagttacattagtgcaattatamcatgaagaaaaatgtattcttcgattttttgtttrccaaacaaataggaggaataatattttattttactttcatatttttaatagtatttatcaaaaktttatccaaacacatgtggtctttttttwaaaaaaaaataatctgaaaacaaggaagcatgcaaactaagaaatgagaaratatattctcaaataaatttaccaagaaagtttttctatcgatttttartctccaaaattatttccaaatcaatacttattaaatcggtgttttcatcttactgtatcatggaaatcagttyttcaaattattttacaaaatagattt

SEQ ID NO: 1347 - DNA, 401 bp, Artificial Sequence
  Consensus Reference Sequence
ctggaacctgccgaayagataactaactattgaccattcattttttttttattacttgacccattaggtgttttwatttttcatttaatttactcccttctccgaatggttgtggacttgcgatggtgccggcctctacccttctgatcatttaggggtggtatgattgtgagggagaaattactattcaagggaaaattawaaaaaaaataatgagtctcayattaaatatttcttcttgttcctctttcattctcttttcttccactcaaccaaccaaaaytaacctaatgcatgcgaaacttacactgcaccggcatagtagattmagattacctagctagggaaagttaatcagcagaattascattaccaaggaaagttcatattaatattggtct

SEQ ID NO: 1348 - DNA, 401 bp, Artificial Sequence
  Consensus Reference Sequence
ctggaacctgccgaayagataactaactattgaccattcattttttttttattacttgacccattaggtgttttwatttttcatttaatttactcccttctccgaatggttgtggacttgcgatggtgccggcctctacccttctgatcatttaggggtggtatgattgtgagggagaaattactattcaagggaaaatttwaaaaaaaataatgagtctcayattaaatatttcttcttgttcctctttcattctcttttcttccactcaaccaaccaaaaytaacctaatgcatgcgaaacttacactgcaccggcatagtagattmagattacctagctagggaaagttaatcagcagaattascattaccaaggaaagttcatattaatattggtct

SEQ ID NO: 1349 - DNA, 401 bp, Artificial Sequence
  Consensus Reference Sequence
ttacaatatttaaamctttttgttcttttcccttccaaaaacactcatgtgactcawtcaattattggcatgtgatgacaccacaaattaaaaaatgcttccatgtaagcaattttstaatgttaactaattagaaggcaaacaaaccgagaagtttgaacttaacaaaaacaacacaaaatctacaagaaaagaaatggtagaaaaaaatgacacgtttacgtgaatgaaaataaatatgtaagtcattaagtagtagttgttactaagaaaagatttgagtgaaattaaactacttatttgaaattataaaaatatcatttaaatcaataaaaaattataaaatyaatgaaataactgtctttatataattttagtattgaaattatatttttacaatt

SEQ ID NO: 1350 - DNA, 401 bp, Artificial Sequence
  Consensus Reference Sequence
ttacaatatttaaamctttttgttcttttcccttccaaaaacactcatgtgactcawtcaattattggcatgtgatgacaccacaaattaaaaaatgcttccatgtaagcaattttstaatgttaactaattagaaggcaaacaaaccgagaagtttgaacttaacaaaaacaacacaaaatctacaagaaaagaaatggaagaaaaaaatgacacgtttacgtgaatgaaaataaatatgtaagtcattaagtagtagttgttactaagaaaagatttgagtgaaattaaactacttatttgaaattataaaaatatcatttaaatcaataaaaaattataaaatyaatgaaataactgtctttatataattttagtattgaaattatatttttacaatt

SEQ ID NO: 1351 - DNA, 401 bp, Artificial Sequence
  Consensus Reference Sequence
tccaaaaacactcatgtgactcawtcaattattggcatgtgatgacaccacaaattaaaaaatgcttccatgtaagcaattttstaatgttaactaattagaaggcaaacaaavcgagaagtttgaacttaacaaaaacaacacaaaatctacaagaaaagaaatggtagaaaaaaatgacacgtttacgtgaatgaaaaaaaatatgtaagtcattaagtagtagttgttactaagaaaagatttgagtgaaattaaactacttatttgaaattataaaaatatcatttaaatcaataaaaaattataaaatyaatgaaataactgtctttatataattttagtattgaaattatatttttacaattaaaaaaawtawattgatttttactcacaaatta

SEQ ID NO: 1352 - DNA, 401 bp, Artificial Sequence
  Consensus Reference Sequence
tccaaaaacactcatgtgactcawtcaattattggcatgtgatgacaccacaaattaaaaaatgcttccatgtaagcaattttstaatgttaactaattagaaggcaaacaaavcgagaagtttgaacttaacaaaaacaacacaaaatctacaagaaaagaaatggtagaaaaaaatgacacgtttacgtgaatgaaaataaatatgtaagtcattaagtagtagttgttactaagaaaagatttgagtgaaattaaactacttatttgaaattataaaaatatcatttaaatcaataaaaaattataaaatyaatgaaataactgtctttatataattttagtattgaaattatatttttacaattaaaaaaawtawattgatttttactcacaaatta

SEQ ID NO: 1353 - DNA, 401 bp, Artificial Sequence
  Consensus Reference Sequence
ataataacactagcaccttwgtgaccctctctcattattttttcttgcatttgaaactttcttatacttgtgagtgacaaggtggytgtttgttttccttttgttttatacactatgctttgttgggaccctccaacctttttctaccgtatgtaagcaaatggaattgcagtgtttcctgtaagaaaaaaaaaagtagtgttttttttttgcaaaattttcatgaagagcttcactgaatgcattgctacataattctagtactactctgatgaagcaagtgcagttcaccctactcctatcagtgtctcttgttattctttttggtccaatcctagttatctcagtagayctttctttcaacgatgatgtgttggggttgataatgttcaaggctggtc

SEQ ID NO: 1354 - DNA, 401 bp, Artificial Sequence
  Consensus Reference Sequence
ataataacactagcaccttwgtgaccctctctcattattttttcttgcatttgaaactttcttatacttgtgagtgacaaggtggytgtttgttttccttttgttttatacactatgctttgttgggaccctccaacctttttctaccgtatgtaagcaaatggaattgcagtgtttcctgtaagaaaaaaaaaagtagttttttttttttgcaaaattttcatgaagagcttcactgaatgcattgctacataattctagtactactctgatgaagcaagtgcagttcaccctactcctatcagtgtctcttgttattctttttggtccaatcctagttatctcagtagayctttctttcaacgatgatgtgttggggttgataatgttcaaggctggtc

SEQ ID NO: 1355 - DNA, 401 bp, Artificial Sequence
  Consensus Reference Sequence
agaaaaaaatcccttctwtttattcaattttttttctcgttctagcgactaaatattttatatcraagcgtcttgaattagacaacattgttttcaaagaaaatgaagtttgggagaatatgttgagtttaattagtggaggtacttcacaaaawttttagaaggaaggtaattgtttagacatttttgttaatgggagccaggaaatctttggaggtgatgatcccctctcaatttccgaataaataaccgaagaacaattaaaactatagaaaaatyaagattccttaaggaagaayccataaatattaaatgatcactgaaataaatcaaataaaaaaaagttgaaggacgaaagtgaaaccaagccttacattaaaagataaaaatattacttttac

SEQ ID NO: 1356 - DNA, 401 bp, Artificial Sequence
  Consensus Reference Sequence
agaaaaaaatcccttctwtttattcaattttttttctcgttctagcgactaaatattttatatcraagcgtcttgaattagacaacattgttttcaaagaaaatgaagtttgggagaatatgttgagtttaattagtggaggtacttcacaaaawttttagaaggaaggtaattgtttagacatttttgttaatgggagcgaggaaatctttggaggtgatgatcccctctcaatttccgaataaataaccgaagaacaattaaaactatagaaaaatyaagattccttaaggaagaayccataaatattaaatgatcactgaaataaatcaaataaaaaaaagttgaaggacgaaagtgaaaccaagccttacattaaaagataaaaatattacttttac

SEQ ID NO: 1357 - DNA, 401 bp, Artificial Sequence
  Consensus Reference Sequence
aaaagtttcataatagagaacaraaggcaagtttcataatagagaagagaagagaagaagtttgagaataaagaagagaacacaagaggagaggtttgaygatagaggccagatggaygatgaacaccaygaaaaacgcgatggcracagtgtcgttatagycatcgtcgaaaccccaaaaacaatcatctgtcgacgacaaagatactagccaacgacaatgtcattaygaccaaccaataaaagtcatatgcgtakaaaaaaatataaaaaagcatacaaaaacgacacagyatatgataaagtccaaacctgggtgtgcgycgttgtggtcaccatcratgggaackattgtatgggtgtgcatcgccgtgtgtcattgtgcatcgccatgtgttgtt

SEQ ID NO: 1358 - DNA, 401 bp, Artificial Sequence
  Consensus Reference Sequence
aaaagtttcataatagagaacaraaggcaagtttcataatagagaagagaagagaagaagtttgagaataaagaagagaacacaagaggagaggtttgaygatagaggccagatggaygatgaacaccaygaaaaacgcgatggcracagtgtcgttatagycatcgtcgaaaccccaaaaacaatcatctgtcgacgacgaagatactagccaacgacaatgtcattaygaccaaccaataaaagtcatatgcgtakaaaaaaatataaaaaagcatacaaaaacgacacagyatatgataaagtccaaacctgggtgtgcgycgttgtggtcaccatcratgggaackattgtatgggtgtgcatcgccgtgtgtcattgtgcatcgccatgtgttgtt

SEQ ID NO: 1359 - DNA, 401 bp, Artificial Sequence
  Consensus Reference Sequence
tggaatctagattaccgaggaagagaaattaaaaacttgaaagaagaattaaaatgatattaaaatcctcattattctattaaaaacaacaataaaataaaraaattctaatcattcttagttaaatttgactatcaattaaacycaattttcatagttatcaagtagtagaagtttttgttgsgaaagygttaagagtgatagtgacattaaatatcgttgcaaaacttttcacaacagatgatattacagtggactgcagcaacaattttctcgctagcaaaagtaagggattaaygaattgtttatggtacgacagttagtcatcatgaagggayaactatcataaacttaattgcacracaacatttgctggatatgattgaacattttgatacaac

SEQ ID NO: 1360 - DNA, 401 bp, Artificial Sequence
  Consensus Reference Sequence
tggaatctagattaccgaggaagagaaattaaaaacttgaaagaagaattaaaatgatattaaaatcctcattattctattaaaaacaacaataaaataaaraaattctaatcattcttagttaaatttgactatcaattaaacycaattttcatagttatcaagtagtagaagtttttgttgsgaaagygttaagagtggtagtgacattaaatatcgttgcaaaacttttcacaacagatgatattacagtggactgcagcaacaattttctcgctagcaaaagtaagggattaaygaattgtttatggtacgacagttagtcatcatgaagggayaactatcataaacttaattgcacracaacatttgctggatatgattgaacattttgatacaac

SEQ ID NO: 1361 - DNA, 401 bp, Artificial Sequence
  Consensus Reference Sequence
tttttaggttcgttgcatgcaacgcaatcagaattgcaatttaaaatcatgtctaaagccatgcaamattgatgcggcatcactaaccagcccccaccatcgtgcacataaacatcggttgcatttgggatgatcccactcgaagagcagctaccaccgaatcaagttaacttcacatttcattcaaaattgtctcttcaagaaacaagctccaggtgccatagatcattaagtaaaacaataattaaaattagggactctggcttttattaatccacgaccatgcaaagaataatatattctgcataattttctcagcattaaaagagccattaattccttaacatacactcattcctagcattccatacacaccaaaatgacattcaccaaaaaaaaaa

SEQ ID NO: 1362 - DNA, 401 bp, Artificial Sequence
  Consensus Reference Sequence
tttttaggttcgttgcatgcaacgcaatcagaattgcaatttaaaatcatgtctaaagccatgcaamattgatgcggcatcactaaccagcccccaccatcgtgcacataaacatcggttgcatttgggatgatcccactcgaagagcagctaccaccgaatcaagttaacttcacatttcattcaaaattgtctcttcatgaaacaagctccaggtgccatagatcattaagtaaaacaataattaaaattagggactctggcttttattaatccacgaccatgcaaagaataatatattctgcataattttctcagcattaaaagagccattaattccttaacatacactcattcctagcattccatacacaccaaaatgacattcaccaaaaaaaaaa

SEQ ID NO: 1363 - DNA, 401 bp, Artificial Sequence
  Consensus Reference Sequence
ttaaactaattaaattaattaaaaagttcttagactactgtctctctaagattatggtcgactaaaaagtaaaaaattaaaacttaaattttagattattaaaaaaaatatttacaattaatttttataaaacaaaaaagacatcatacatattatattgacaaaaaaatatgccaaacatataattgtcaattttttttawaaaaaaaattattttagattccacccataattgaactgccctccctcaactagatcacttcacttaaaactttcgcttgtcaattttccatacttcgtctgggattagtcaatcttcgtataatgaccaatgtaccataatatacgaacaattagtccccatgatggtcagtcatgtgacatgtatagtagcagtaaac

SEQ ID NO: 1364 - DNA, 401 bp, Artificial Sequence
  Consensus Reference Sequence
ttaaactaattaaattaattaaaaagttcttagactactgtctctctaagattatggtcgactaaaaagtaaaaaattaaaacttaaattttagattattaaaaaaaatatttacaattaatttttataaaacaaaaaagacatcatacatattatattgacaaaaaaatatgccaaacatataattgtcaatttttttttwaaaaaaaattattttagattccacccataattgaactgccctccctcaactagatcacttcacttaaaactttcgcttgtcaattttccatacttcgtctgggattagtcaatcttcgtataatgaccaatgtaccataatatacgaacaattagtccccatgatggtcagtcatgtgacatgtatagtagcagtaaac

SEQ ID NO: 1365 - DNA, 401 bp, Artificial Sequence
  Consensus Reference Sequence
tttttctttatttatgctcctttttgcttgttgtacctccctttttcacatctgcagtcaaaattcaaaattaattaaatctttccaaattaaagcataaataactgctaaataattaattctaagttaatttcagaccgattttccactattaattcactattatttagytgttatcaaaatcccccaaattaaactttatttgtccccaagcaaataaaaagaataaaattattccattcttaagcaaaattttctcaagcaagttccaatcattccaacactctccatgacttcaattccttgatcccttgactggtcccttcgcatctgtcatgatcttaaaataaaagcataaacacgagagtagaaacaactcaattatctggaattccaacagg

SEQ ID NO: 1366 - DNA, 401 bp, Artificial Sequence
  Consensus Reference Sequence
tttttctttatttatgctcctttttgcttgttgtacctccctttttcacatctgcagtcaaaattcaaaattaattaaatctttccaaattaaagcataaataactgctaaataattaattctaagttaatttcagaccgattttccactattaattcactattatttagytgttatcaaaatcccccaaattaaactttctttgtccccaagcaaataaaaagaataaaattattccattcttaagcaaaattttctcaagcaagttccaatcattccaacactctccatgacttcaattccttgatcccttgactggtcccttcgcatctgtcatgatcttaaaataaaagcataaacacgagagtagaaacaactcaattatctggaattccaacagg

SEQ ID NO: 1367 - DNA, 401 bp, Artificial Sequence
  Consensus Reference Sequence
gtggactaaaccctaayagaaaataaggtycgagatacaggataaataagaaagaacggtaaataaaagaacctggaaggaaatcctctttttattgataactcttgaaatgctccatacatcattgrctttttaggcctgycaggycctarctaggggtttagccactcatagtcatgagggctttacaatgagaagggaggggggggtgaaagaaaggtaataagaatataagaaaarggaaggaaatggagagaactgagtgccaaaagtctaaaaacagagctctgaggaagtgtgttcgttttcctaggctaaccttattatttataggtgcaaaattgggctttgggtcttcgtagtcccgctgagcgcgaagcctcgcgctcagcgccacctcg

SEQ ID NO: 1368 - DNA, 401 bp, Artificial Sequence
  Consensus Reference Sequence
gtggactaaaccctaayagaaaataaggtycgagatacaggataaataagaaagaacggtaaataaaagaacctggaaggaaatcctctttttattgataactcttgaaatgctccatacatcattgrctttttaggcctgycaggycctarctaggggtttagccactcatagtcatgagggctttacaatgagaaggggggggggggtgaaagaaaggtaataagaatataagaaaarggaaggaaatggagagaactgagtgccaaaagtctaaaaacagagctctgaggaagtgtgttcgttttcctaggctaaccttattatttataggtgcaaaattgggctttgggtcttcgtagtcccgctgagcgcgaagcctcgcgctcagcgccacctcg

SEQ ID NO: 1369 - DNA, 401 bp, Artificial Sequence
  Consensus Reference Sequence
ttgagaatacttataagctggaagtggtacgraaaaatacttgttgtaatcaagtttgattagtgaratcctttactggttagtaaaggagaactagacgtaactcaggttaagtgacccgrtataaattggagtatttttactgtyttttttttaatttatcaaagtatttcaaagtcaattattgataatttagcacacaaagttttcagtgaaaaataagttttatatatcattggacgamaatccattttttgtcactggccgagggtttttataaacatcttycattttaaaaggttttatattttgattaacacactatttcacccstttctagtgtgatgtattgtattccaattattttgattaattatatttgaaggaaatgttattaaaac

SEQ ID NO: 1370 - DNA, 401 bp, Artificial Sequence
  Consensus Reference Sequence
ttgagaatacttataagctggaagtggtacgraaaaatacttgttgtaatcaagtttgattagtgaratcctttactggttagtaaaggagaactagacgtaactcaggttaagtgacccgrtataaattggagtatttttactgtyttttttttaatttatcaaagtatttcaaagtcaattattgataatttagcacagaaagttttcagtgaaaaataagttttatatatcattggacgamaatccattttttgtcactggccgagggtttttataaacatcttycattttaaaaggttttatattttgattaacacactatttcacccstttctagtgtgatgtattgtattccaattattttgattaattatatttgaaggaaatgttattaaaac

SEQ ID NO: 1371 - DNA, 401 bp, Artificial Sequence
  Consensus Reference Sequence
ttataatatatttgtctaaattatttttgttttaaaaaatttacttcttttaacaaataaattccatttttttcttaaaaaaaattatttttaaattattttaaaaaatttaaacaaactcaacttttatttaaattgtttgtgcttttaaaaaaataatttttttcttgttttaagaaataaattctatctatttttttaaaaaaaatatttgtatcagctatacgaatatctaaataaagagactaaatattgttgtcttggagtggtatgttttcaatttctctctctatataattataattattttattatattawtaaatgtgacgtatggatgaaacactgattactatactatttctgcacacatttttattttgctttaatcttagaaaktac

SEQ ID NO: 1372 - DNA, 401 bp, Artificial Sequence
  Consensus Reference Sequence
ttataatatatttgtctaaattatttttgttttaaaaaatttacttcttttaacaaataaattccatttttttcttaaaaaaaattatttttaaattattttaaaaaatttaaacaaactcaacttttatttaaattgtttgtgcttttaaaaaaataatttttttcttgttttaagaaataaattctatctattttttttaaaaaaatatttgtatcagctatacgaatatctaaataaagagactaaatattgttgtcttggagtggtatgttttcaatttctctctctatataattataattattttattatattawtaaatgtgacgtatggatgaaacactgattactatactatttctgcacacatttttattttgctttaatcttagaaaktac

SEQ ID NO: 1373 - DNA, 401 bp, Artificial Sequence
  Consensus Reference Sequence
catcttgttggattaagtttagatcttygtcggaaagtacggaggatgaagtttctgtttcttcctccgaagtttctatgagcaaattgtttatttgttcttcgattgtgggttctaggttaaggtttcttaatttcttctttagtctacaatacttactaatgtggccttgttttccayaattgtagcacattatttttgattttattktttgcttaggattttccatttccttactagttgagggtttttgtgaatatcttctttttgaaaatcttcttttattggctggtttatgatcctggatttctytcctagaggattgttttttcttttgttttgggcaggctggtaagccaaattgttcacagaaggaacctaaatccttctttgtttgagtc

SEQ ID NO: 1374 - DNA, 401 bp, Artificial Sequence
  Consensus Reference Sequence
catcttgttggattaagtttagatcttygtcggaaagtacggaggatgaagtttctgtttcttcctccgaagtttctatgagcaaattgtttatttgttcttcgattgtgggttctaggttaaggtttcttaatttcttctttagtctacaatacttactaatgtggccttgttttccayaattgtagcacattattttttattttattktttgcttaggattttccatttccttactagttgagggtttttgtgaatatcttctttttgaaaatcttcttttattggctggtttatgatcctggatttctytcctagaggattgttttttcttttgttttgggcaggctggtaagccaaattgttcacagaaggaacctaaatccttctttgtttgagtc

SEQ ID NO: 1375 - DNA, 401 bp, Artificial Sequence
  Consensus Reference Sequence
taacygaactagttccactattggatcggtcatgcaattgacatgggatgatctatccaaactcggacakttagccaccaratccygrttgcaccggtcygacctgatcagttttacacacaaaaagggaccatctctamgacatcattttgatatctaattattataaattgttatcttggattttgaagtatggatgaatttttttttactcaaataatgttagttgtatacttatatataatatatacatatataattttgaatttwtataatawattaagtcaaaccagtccaatggttaatctatcagttggaccactgtccattcatcaaytattttaattggatcaatgaccgaacyaggtttcacaactatgattgcaagcataacattacaa

SEQ ID NO: 1376 - DNA, 401 bp, Artificial Sequence
  Consensus Reference Sequence
taacygaactagttccactattggatcggtcatgcaattgacatgggatgatctatccaaactcggacakttagccaccaratccygrttgcaccggtcygacctgatcagttttacacacaaaaagggaccatctctamgacatcattttgatatctaattattataaattgttatcttggattttgaagtatggatgattttttttttactcaaataatgttagttgtatacttatatataatatatacatatataattttgaatttwtataatawattaagtcaaaccagtccaatggttaatctatcagttggaccactgtccattcatcaaytattttaattggatcaatgaccgaacyaggtttcacaactatgattgcaagcataacattacaa

SEQ ID NO: 1377 - DNA, 401 bp, Artificial Sequence
  Consensus Reference Sequence
tttcttaccttcttttgggtggcagctttggtgaaaacatggtcgagtaagtcatcggcctcatagacagcatctttgagatcattgagccagtgtttgacattggtgtttgtgatctgtttcttctcggcatcatsaagcacagctccaaccactctgagagtggtctccaacttttgaagcaacttcttgctaagcttatttccaaggatcaagtgaacaaactcasgtgaagccagcctgtcgaaaaccacatcaaggaaagcagagagaaaggcaccacckaccastgctgctgccattatctcaagaacaaaagatgatcagagtagaaagacraaggcaaggaattggttgctatgaacggtttttttatttattatggtggtggtggctgactt

SEQ ID NO: 1378 - DNA, 401 bp, Artificial Sequence
  Consensus Reference Sequence
tttcttaccttcttttgggtggcagctttggtgaaaacatggtcgagtaagtcatcggcctcatagacagcatctttgagatcattgagccagtgtttgacattggtgtttgtgatctgtttcttctcggcatcatsaagcacagctccaaccactctgagagtggtctccaacttttgaagcaacttcttgctaagcttctttccaaggatcaagtgaacaaactcasgtgaagccagcctgtcgaaaaccacatcaaggaaagcagagagaaaggcaccacckaccastgctgctgccattatctcaagaacaaaagatgatcagagtagaaagacraaggcaaggaattggttgctatgaacggtttttttatttattatggtggtggtggctgactt

SEQ ID NO: 1379 - DNA, 401 bp, Artificial Sequence
  Consensus Reference Sequence
aaaaaatgatctacaattttttgattttgtttttarcaatgtctaagaagtatgtatgttcttcartttaccgaattgcaattgtatatttattatgcttttatcaattcttacgtatctacatatctatcatatttttagaataatcataccaytattaatttataggacagggrataagagataagctgaaatcatccaatccttctaaagttcacttggtacamcttttcatccttcacattgtacccaacgaaaaacctcacaaataaaaattcagctattgagaaagtgtcaatttgacatcaattaaattaaaagttacatttagcactagttcaaatttgaacttagattcatgggtaggtacartttctccgggccaatcaaccatrtctgaa

SEQ ID NO: 1380 - DNA, 401 bp, Artificial Sequence
  Consensus Reference Sequence
aaaaaatgatctacaattttttgattttgtttttarcaatgtctaagaagtatgtatgttcttcartttaccgaattgcaattgtatatttattatgcttttatcaattcttacgtatctacatatctatcatatttttagaataatcataccaytattaatttataggacagggrataagagataagctgaaatcatccgatccttctaaagttcacttggtacamcttttcatccttcacattgtacccaacgaaaaacctcacaaataaaaattcagctattgagaaagtgtcaatttgacatcaattaaattaaaagttacatttagcactagttcaaatttgaacttagattcatgggtaggtacartttctccgggccaatcaaccatrtctgaa

SEQ ID NO: 1381 - DNA, 401 bp, Artificial Sequence
  Consensus Reference Sequence
gaagcatactacagttgtcacaatcaagtaaggttagacktgtcatattgcagtaggaagaatttcccatccaatctggaaatctggttcctttatagccttytatatacaacgattcaatgttaaagtgaggctgtaacttgcaaagcacatctatttcaagttggaagttggtactgttgttgttacatccagaccataccaactgtaaactattaatgtgttttttatccatcatccttgcctccaacgcttcatcactttgggaaacattctccatgttcctaakttcaagatsaccacgaagatttgaaagtcctcccaattctttgattccattctcttcgtgcttgcccacaacaaagaaatccagacgttgtaaatgatttaatttactcatt

SEQ ID NO: 1382 - DNA, 401 bp, Artificial Sequence
  Consensus Reference Sequence
gaagcatactacagttgtcacaatcaagtaaggttagacktgtcatattgcagtaggaagaatttcccatccaatctggaaatctggttcctttatagccttytatatacaacgattcaatgttaaagtgaggctgtaacttgcaaagcacatctatttcaagttggaagttggtactgttgttgttacatccagaccattccaactgtaaactattaatgtgttttttatccatcatccttgcctccaacgcttcatcactttgggaaacattctccatgttcctaakttcaagatsaccacgaagatttgaaagtcctcccaattctttgattccattctcttcgtgcttgcccacaacaaagaaatccagacgttgtaaatgatttaatttactcatt

SEQ ID NO: 1383 - DNA, 401 bp, Artificial Sequence
  Consensus Reference Sequence
aagcaacttcttgctaagcttctttccacggatcagrtcaacaaastcaggtgaagccagcctgtcgaaaagcacatcaaggaaagcagagagaaaggcaccacckaccagtgctgcagccatkatctcaagaacaaaagatgatcagagtagaaagacaaaggcaagggaattggwtgctatgaactgggttggttcttcgtaaggttaactgatktgatgagatttggcttaagtcaactctcttcaccttcactcgttctgctgtgcaagacaaaagtatggtcttttttatttgtattattatggtggtgggtgacttatcrcgttgggagtctctttcctsttccccacatgttkctttcttgatatttctattttgaatttagctcctctaaact

SEQ ID NO: 1384 - DNA, 401 bp, Artificial Sequence
  Consensus Reference Sequence
aagcaacttcttgctaagcttctttccacggatcagrtcaacaaastcaggtgaagccagcctgtcgaaaagcacatcaaggaaagcagagagaaaggcaccacckaccagtgctgcagccatkatctcaagaacaaaagatgatcagagtagaaagacaaaggcaagggaattggwtgctatgaactgggttggttcttggtaaggttaactgatktgatgagatttggcttaagtcaactctcttcaccttcactcgttctgctgtgcaagacaaaagtatggtcttttttatttgtattattatggtggtgggtgacttatcrcgttgggagtctctttcctsttccccacatgttkctttcttgatatttctattttgaatttagctcctctaaact

SEQ ID NO: 1385 - DNA, 401 bp, Artificial Sequence
  Consensus Reference Sequence
tgaaaaacgtgcttccaactaaaaaaaaaaccataatactagtaattaagttttccaaccaaacacattagttgaaactctgttaaaagaaaatattagttgaagcttytaaggtttaagtaacagttataactgtcaaagcttttaatactaatataaaaatgwttttccgtattactactattatgtaaatattttttaaaattgctatgttatttgtgtttaatttgtakacgcacttaatgtaaaatgyttttccgtactattatccaaatattaaattttaattgctttgttatttgagtttattgtaaaatatttttatgttttgtacaaaatcattttatcgctagattataataattattaagatgatgatgtgataaatttcytctamaaaa

SEQ ID NO: 1386 - DNA, 401 bp, Artificial Sequence
  Consensus Reference Sequence
tgaaaaacgtgcttccaactaaaaaaaaaaccataatactagtaattaagttttccaaccaaacacattagttgaaactctgttaaaagaaaatattagttgaagcttytaaggtttaagtaacagttataactgtcaaagcttttaatactaatataaaaatgwttttccgtattactactattatgtaaatatttttttaaattgctatgttatttgtgtttaatttgtakacgcacttaatgtaaaatgyttttccgtactattatccaaatattaaattttaattgctttgttatttgagtttattgtaaaatatttttatgttttgtacaaaatcattttatcgctagattataataattattaagatgatgatgtgataaatttcytctamaaaa

SEQ ID NO: 1387 - DNA, 401 bp, Artificial Sequence
  Consensus Reference Sequence
attatcgaaatataaaaaaactaaaaaaatatatttattgattaacataacatatgtttgaattaattttatacaaaaaagttagtagctratttattattaaataaaaatcattttattttatcacatgtataaattaaattatttataacaaggatttttacttttcattttagtttcacaagtacaacctgtaaaaaaaataattaaatgttttattacacaacttatgtaaaaagcatagattttggaggaaaagtattataactacatgattttactagcatatattgcaatttatattgtaatattcttgttatctgygtttacagtgtaatataaatatagatatagtacggatacagataaaagataaasatgaatattatttatacttcaat

SEQ ID NO: 1388 - DNA, 401 bp, Artificial Sequence
  Consensus Reference Sequence
attatcgaaatataaaaaaactaaaaaaatatatttattgattaacataacatatgtttgaattaattttatacaaaaaagttagtagctratttattattaaataaaaatcattttattttatcacatgtataaattaaattatttataacaaggatttttacttttcattttagtttcacaagtacaacctgtaaaaataataattaaatgttttattacacaacttatgtaaaaagcatagattttggaggaaaagtattataactacatgattttactagcatatattgcaatttatattgtaatattcttgttatctgygtttacagtgtaatataaatatagatatagtacggatacagataaaagataaasatgaatattatttatacttcaat

SEQ ID NO: 1389 - DNA, 401 bp, Artificial Sequence
  Consensus Reference Sequence
aaaaaggtcatgtgaatagtatcatcaagaaaaaaatcaagcttttatcatgtyaagaaattcttttattacttacatacagtttaaaaattaaaaaagtatataaagataaaaaaaygtattaataaaaaattagaattaattaataactttctatttgattttttcaaaaataaaaataaaataaagagtgagaaaaaaatatrttactrtytattattatgaaagtcgatcatattcaaatgtttgatgttcaatatatataaagtaaacaaaactgtgttctcattttttaagtcatattttttaaaacttctgttaaaaaaagtcatgtttcaatatatataatagaatttattttatttaaagagaagagcttgaaatgaacaagtgacagatat

SEQ ID NO: 1390 - DNA, 401 bp, Artificial Sequence
  Consensus Reference Sequence
aaaaaggtcatgtgaatagtatcatcaagaaaaaaatcaagcttttatcatgtyaagaaattcttttattacttacatacagtttaaaaattaaaaaagtatataaagataaaaaaaygtattaataaaaaattagaattaattaataactttctatttgattttttcaaaaataaaaataaaataaagagtgagaaaaatatatrttactrtytattattatgaaagtcgatcatattcaaatgtttgatgttcaatatatataaagtaaacaaaactgtgttctcattttttaagtcatattttttaaaacttctgttaaaaaaagtcatgtttcaatatatataatagaatttattttatttaaagagaagagcttgaaatgaacaagtgacagatat

SEQ ID NO: 1391 - DNA, 401 bp, Artificial Sequence
  Consensus Reference Sequence
attaatagaatatggatttagttggaatacacaaggctttttaaactattatcymatcatgaattatatataactaaatawtcttaattttataataattaatttaatagtaacaatatctaggataatttctcattaattaagtaattattaaaaaaatttactaactgtttaacaaaattaatctcgtagaatcaatgctatttataacaaaattaatttagcgtttttatgatttctcctagaatcaatgctatttataacaaacagcaaataggttttcaacgaattagtgaattactcttttacttttatgtaaaactaaaaaacaataaaccatgggaaaaaaaatcatcatacacacttatgtgtggaaaataaycattgtacacctaagatag

SEQ ID NO: 1392 - DNA, 401 bp, Artificial Sequence
  Consensus Reference Sequence
attaatagaatatggatttagttggaatacacaaggctttttaaactattatcymatcatgaattatatataactaaatawtcttaattttataataattaatttaatagtaacaatatctaggataatttctcattaattaagtaattattaaaaaaatttactaactgtttaacaaaattaatctcgtagaatcaatgttatttataacaaaattaatttagcgtttttatgatttctcctagaatcaatgctatttataacaaacagcaaataggttttcaacgaattagtgaattactcttttacttttatgtaaaactaaaaaacaataaaccatgggaaaaaaaatcatcatacacacttatgtgtggaaaataaycattgtacacctaagatag

SEQ ID NO: 1393 - DNA, 401 bp, Artificial Sequence
  Consensus Reference Sequence
caagttcattttgtttagagcaaartccaagtttcttccaagccttctatccaagtatgcatcaactacacacccaaaagtcactagatcaggmatgacmttctcatgttcyatatgttcaatgctaagrtggaggtcccagaacaaagccatccttgagaaggccagagcacgaatattraaggtcgtaatatccggacagaacccagattcaaccattctgacaaattctcgctgcaagcttttcatcttgaaattggcagcataagaaagtaacatwaggttccacaaaaggtttcctacgtttttcctatgwrgacccacatctcttaggaactcacccaattcgtagaattttctctcctttatatacgcagaggccacagcgcgaatcgctccct

SEQ ID NO: 1394 - DNA, 401 bp, Artificial Sequence
  Consensus Reference Sequence
caagttcattttgtttagagcaaartccaagtttcttccaagccttctatccaagtatgcatcaactacacacccaaaagtcactagatcaggmatgacmttctcatgttcyatatgttcaatgctaagrtggaggtcccagaacaaagccatccttgagaaggccagagcacgaatattraaggtcgtaatatccggacggaacccagattcaaccattctgacaaattctcgctgcaagcttttcatcttgaaattggcagcataagaaagtaacatwaggttccacaaaaggtttcctacgtttttcctatgwrgacccacatctcttaggaactcacccaattcgtagaattttctctcctttatatacgcagaggccacagcgcgaatcgctccct

That which is claimed:

1. A method of introgressing tolerance to *Phytophthora* infection, from a first soybean plant or a first soybean germplasm that displays tolerance to *Phytophthora* infection compared to a susceptible plant, into a second soybean plant or second soybean germplasm, the method comprising:
    detecting in the genome of said first soybean plant or in the genome of said first soybean germplasm at least one marker locus that is associated with the tolerance, wherein the at least one marker locus comprises 808291-1,
    wherein the detecting comprises amplifying the at least one marker locus and detecting the resulting amplified marker amplicon,
thereby selecting a first soybean plant or a first soybean germplasm that displays tolerance to *Phytophthora* infection compared to a susceptible plant, and
    crossing the selected first soybean plant or first soybean germplasm comprising said at least one maker locus with a second soybean plant or second soybean germplasm,
    thereby introgressing the tolerance to *Phytophthora* infection into said second soybean plant or second soybean germplasm.

2. The method of claim 1, wherein at least two marker loci are detected.

3. The method of claim 2, wherein the at least two marker loci comprise a haplotype or a marker profile that is associated with said tolerance.

4. The method of claim 1, wherein the germplasm comprises a soybean variety.

5. The method of claim 1, wherein the second soybean plant or second soybean germplasm comprises an exotic soybean strain or an elite soybean strain.

6. The method of claim 1, further comprising DNA sequencing of at least one of said marker loci.

7. The method of claim 1, wherein the amplifying comprises:
    a) admixing an amplification primer or amplification primer pair for each marker locus being amplified with a nucleic acid isolated from the first soybean plant or the first soybean germplasm, wherein the primer or primer pair is complementary or partially complementary to the genomic locus comprising the marker locus, and is capable of initiating DNA polymerization by a DNA polymerase using the soybean nucleic acid as a template; and
    b) extending the primer or primer pair in a DNA polymerization reaction comprising a DNA polymerase and a template nucleic acid to generate at least one amplicon.

8. The method of claim 7, wherein said method comprises amplifying one or more polynucleotides comprising SEQ ID NOs: 155 or 156.

9. The method of claim 7, wherein said primer or primer pair comprises
    a fragment of one or more polynucleotides comprising SEQ ID NOs: 155 or 156.

10. The method of claim 9, wherein said primer or primer pair comprises a nucleic acid sequence comprising a nucleic acid sequence comprising SEQ ID NOs: 1 or 2.

11. The method of claim 10, wherein said primer pair comprises: SEQ ID NO: 1 and SEQ ID NO:2.

12. The method of claim 7, wherein the method further comprises providing one or more labeled nucleic acid probes suitable for detection of each marker locus being amplified.

13. The method of claim 12, wherein said labeled nucleic acid probe comprises a nucleic acid sequence comprising:
    one or more polynucleotides comprising SEQ ID NOs: 155 or 156.

* * * * *

UNITED STATES PATENT AND TRADEMARK OFFICE
CERTIFICATE OF CORRECTION

PATENT NO. : 9,493,843 B2  
APPLICATION NO. : 13/782013  
DATED : November 15, 2016  
INVENTOR(S) : Julian Marco Chaky et al.

It is certified that error appears in the above-identified patent and that said Letters Patent is hereby corrected as shown below:

In the Claims

Claim 1
At Column 85, Line 24, replace "808291-1" with --S08291-1--.

Signed and Sealed this
Twenty-fourth Day of January, 2017

Michelle K. Lee
*Director of the United States Patent and Trademark Office*